United States Patent
Smargon et al.

(10) Patent No.: US 12,234,454 B2
(45) Date of Patent: Feb. 25, 2025

(54) CRISPR ENZYMES AND SYSTEMS

(71) Applicants: THE BROAD INSTITUTE, INC., Cambridge, MA (US); MASSACHUSETTS INSTITUTE OF TECHNOLOGY, Cambridge, MA (US)

(72) Inventors: Aaron Andrew Smargon, Cambridge, MA (US); Feng Zhang, Cambridge, MA (US)

(73) Assignees: THE BROAD INSTITUTE, INC., Cambridge, MA (US); MASSACHUSETTS INSTITUTE OF TECHNOLOGY, Cambridge, MA (US)

(*) Notice: Subject to any disclaimer, the term of this patent is extended or adjusted under 35 U.S.C. 154(b) by 850 days.

(21) Appl. No.: 15/331,792

(22) Filed: Oct. 21, 2016

(65) Prior Publication Data

US 2017/0211142 A1    Jul. 27, 2017

Related U.S. Application Data

(60) Provisional application No. 62/376,382, filed on Aug. 17, 2016, provisional application No. 62/376,367, filed on Aug. 17, 2016, provisional application No. 62/296,548, filed on Feb. 17, 2016, provisional application No. 62/245,270, filed on Oct. 22, 2015.

(51) Int. Cl.
| | | |
|---|---|---|
| *C12N 15/113* | (2010.01) | |
| *C12N 9/22* | (2006.01) | |
| *C12N 15/10* | (2006.01) | |
| *C12N 15/11* | (2006.01) | |
| *C12N 15/63* | (2006.01) | |
| *C12N 15/74* | (2006.01) | |
| *C12Q 1/6876* | (2018.01) | |
| *G16B 25/00* | (2019.01) | |
| *G16B 30/00* | (2019.01) | |
| *G16B 30/10* | (2019.01) | |
| *G16B 30/20* | (2019.01) | |

(52) U.S. Cl.
CPC ............ *C12N 15/113* (2013.01); *C12N 9/22* (2013.01); *C12N 15/102* (2013.01); *C12N 15/111* (2013.01); *C12N 15/63* (2013.01); *C12N 15/74* (2013.01); *C12Q 1/6876* (2013.01); *G16B 25/00* (2019.02); *G16B 30/00* (2019.02); *G16B 30/10* (2019.02); *G16B 30/20* (2019.02); *C12N 2310/20* (2017.05); *C12Q 2600/156* (2013.01)

(58) Field of Classification Search
None
See application file for complete search history.

(56) References Cited

U.S. PATENT DOCUMENTS

| | | |
|---|---|---|
| 6,603,061 B1 | 8/2003 | Armstrong et al. |
| 7,868,149 B2 | 1/2011 | Boukharov et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 2004/0171156 A1 | 9/2004 | Hartley et al. |
| 2009/0100536 A1 | 4/2009 | Adams et al. |
| 2011/0059502 A1 | 3/2011 | Chalasani et al. |
| 2011/0265198 A1 | 10/2011 | Gregory et al. |
| 2012/0017290 A1 | 1/2012 | Cui et al. |
| 2013/0185823 A1 | 7/2013 | Kuang et al. |
| 2013/0236946 A1 | 9/2013 | Gouble |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |

(Continued)

FOREIGN PATENT DOCUMENTS

| | | |
|---|---|---|
| EP | 2 764 103 A2 | 8/2014 |
| EP | 2 771 468 A1 | 9/2014 |

(Continued)

OTHER PUBLICATIONS

Shmakov et al Discovery and functional characterization of diverse Class 2 CRISPR-Cas systems Mol Cell. Nov. 5, 2015; 60(3): 385-397. doi:10.1016/j.molcel.2015.10.008.*
Krzysztof et al. Classification and evolution of type II CRISPR-Cas systems Nucleic Acids Research, 2014, vol. 42, No. 10 6091-6105 doi: 10.1093/nar/gku241.*
Abudayyeh, et al., "C2c2 is a Single-Component Programmable RNA-Guided RNA-Targeting CRISPR Effector", Science, vol. 353, No. 6299, Aug. 5, 2016, 11 pages.
Anantharaman, et al., "Comprehensive Analysis of the HEPN Superfamily: Identification of Novel Roles in Intra-Genomic Conflicts, Defense, Pathogenesis and RNA Processing", Biology Direct, vol. 8, No. 15, Jun. 15, 2013, 1-28.

(Continued)

*Primary Examiner* — Joseph Woitach
(74) *Attorney, Agent, or Firm* — F. Brent Nix, Esq.; Johnson, Marcou, Isaacs & Nix, LLC

(57) ABSTRACT

The invention provides for systems, methods, and compositions for targeting nucleic acids. In particular, the invention provides non-naturally occurring or engineered DNA or RNA-targeting systems comprising a novel DNA or RNA-targeting CRISPR effector protein and at least one targeting nucleic acid component like a guide RNA.

27 Claims, 257 Drawing Sheets

Specification includes a Sequence Listing.

(56) References Cited

U.S. PATENT DOCUMENTS

| | | |
|---|---|---|
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0287938 A1 | 9/2014 | Zhang et al. |
| 2014/0310830 A1 | 10/2014 | Zhang et al. |
| 2014/0357530 A1 | 12/2014 | Zhang et al. |
| 2018/0066242 A1 | 3/2018 | Zhang et al. |

FOREIGN PATENT DOCUMENTS

| | | |
|---|---|---|
| EP | 2 784 162 A1 | 10/2014 |
| WO | 2008/042156 A1 | 4/2008 |
| WO | 2014/018423 A2 | 1/2014 |
| WO | 2014/093595 A1 | 6/2014 |
| WO | 2014/093622 A2 | 6/2014 |
| WO | 2014/093635 A1 | 6/2014 |
| WO | 2014/093655 A2 | 6/2014 |
| WO | 2014/093661 A2 | 6/2014 |
| WO | 2014/093694 A1 | 6/2014 |
| WO | 2014/093701 A1 | 6/2014 |
| WO | 2014/093709 A1 | 6/2014 |
| WO | 2014/093712 A1 | 6/2014 |
| WO | 2014/093718 A1 | 6/2014 |
| WO | 2014/204723 A1 | 12/2014 |
| WO | 2014/204724 A1 | 12/2014 |
| WO | 2014/204725 A1 | 12/2014 |
| WO | 2014/204726 A1 | 12/2014 |
| WO | 2014/204727 A1 | 12/2014 |
| WO | 2014/204728 A1 | 12/2014 |
| WO | 2014/204729 A1 | 12/2014 |
| WO | 2015/065964 A1 | 5/2015 |
| WO | 2015/089351 A1 | 6/2015 |
| WO | 2015/089419 A2 | 6/2015 |
| WO | 2015/089427 A1 | 6/2015 |
| WO | 2016/028682 A1 | 2/2016 |
| WO | 2016/049024 A2 | 3/2016 |
| WO | 2016/049163 A2 | 3/2016 |
| WO | 2016/049258 A1 | 3/2016 |
| WO | 2016/094874 A1 | 6/2016 |
| WO | 2016/094880 A1 | 6/2016 |
| WO | 2016/106236 A1 | 6/2016 |
| WO | 2017/070605 A1 | 4/2017 |

OTHER PUBLICATIONS

Banaszynski, et al., "A Rapid, Reversible, and Tunable Method to Regulate Protein Function in Living Cells Using Synthetic Small Molecules", Cell, vol. 126, No. 5, Sep. 8, 2006, 995-1004.

Banaszynski, et al., "Chemical Control of Protein Stability and Function in Living Mice", Nature Medicine, vol. 14, No. 10, Oct. 2008, 1123-1127.

Belhaj, et al., "Plant Genome Editing Made Easy: Targeted Mutagenesis in Model and Crop Plants Using the CRISPR/Cas System", Plant Methods, vol. 9, No. 39, Oct. 11, 2013, 10 pages.

Biswas, et al., "CRISPRTarget Bioinformatic Prediction and Analysis of CrRNA Targets", RNA Biology, vol. 10, No. 5, May 2013, 817-827.

Brooks, et al., "Efficient Gene Editing in Tomato in the First Generation Using the Clustered Regularly Interspaced Short Palindromic Repeats/CRISPR-Associated9 System", Plant Physiology, vol. 166, No. 3, Nov. 2014, 1292-1297.

Brouns, et al., "Small CRISPR RNAs Guide Antiviral Defense in Prokaryotes", Science, vol. 321, No. 5891, Aug. 15, 2008, 960-964.

Caliando, et al., "Targeted DNA Degradation using a CRISPR Device Stably Carried in the Host Genome", Nature Communications, vol. 6, May 19, 2015, 10 pages.

Canver, et al., "BCL11A Enhancer Dissection by Cas9-Mediated In Situ Saturating Mutagenesis", Nature, vol. 527, Nov. 12, 2015, 192-197.

Chen, et al., "Genome-Wide CRISPR Screen in a Mouse Model of Tumor Growth and Metastasis", Cell, vol. 160, No. 6, Mar. 12, 2015, 1246-1260.

Cong, et al., "Multiplex Genome Engineering Using CRISPR/Cas Systems", Science, vol. 339, No. 6121, Feb. 14, 2013, 819-823.

Harrison, et al., "A CRISPR View of Development", Genes & Development, vol. 28, Sep. 1, 2014, 1859-1872.

Dahlman, et al., "Orthogonal Gene Knock Out and Activation with a Catalytically Active Cas9 Nuclease", Nature Biotechnology, vol. 33, No. 11, Nov. 2015, 1159-1161.

Doench, et al., "Rational Design of Highly Active Sgrnas for CRISPR-Cas9-Mediated Gene Inactivation", Nature Biotechnology, vol. 32, No. 12, Sep. 3, 2014, 1262-1267.

East-Seletsky, et al., "Two Distinct RNase Activities of CRISPR-C2c2 Enable Guide-RNA Processing and RNA Detection", Nature, vol. 538, No. 7624, Oct. 13, 2016, 270-273.

Edgar, "PILER-CR: Fast and Accurate Identification of CRISPR Repeats", BMC Bioinformatics, vol. 8, No. 18, 2007, 6 pages.

Feng, et al., "Efficient Genome Editing in Plants using a CRISPR/Cas System", Cell Research, vol. 23, Aug. 20, 2013, 1229-1232.

Hale, et al., "Essential Features and Rational Design of CRISPR RNAs that Function with the Cas RAMP Module Complex to Cleave RNAs", Molecular Cell, vol. 45, Issue 3, Feb. 10, 2012, 292-302.

Hale, et al., "RNA-Guided RNA Cleavage by a CRISPR RNA-Cas Protein Complex", Cell, vol. 139, No. 5, Nov. 25, 2009, 945-956.

Hale, et al., "Target RNA Capture and Cleavage by the Cmr Type III-B CRISPR-Cas Effector Complex", Genes & Development, vol. 28, No. 21, Sep. 29, 2014, 2432-2443.

Hebelstrup, et al., "The Future of Starch Bioengineering: GM Microorganisms or GM Plants?", Frontiers in Plant Science, vol. 6, Article 247, Apr. 23, 2015, 6 pages.

Heidrich, et al., "Investigating CRISPR RNA Biogenesis and Function Using RNA-Seq", Methods in Molecular Biology, vol. 1311, 2015, 21 pages.

Hlavova, et al., "Improving Microalgae for Biotechnology—From Genetics to Synthetic Biology", Biotechnology Advances, vol. 33, Issue 6, Part 2, Nov. 2015, 1194-1203.

Hsu, et al., "Development and Applications of CRISPR-Cas9 for Genome Engineering", Cell, vol. 157, No. 6,, Jun. 5, 2014, 1262-1278.

Hsu, et al., "DNA Targeting Specificity of RNA-Guided Cas9 Nucleases", Nat. Biotechnol. vol. 31, No. 9, Sep. 2013, 827-832.

Jansen, et al., "Identification of a Novel Family of Sequence Repeats among Prokaryotes", OMICS: A Journal of Integrative Biology, vol. 6, No. 1, Feb. 2002 , 23-33.

Jansen, et al., "Identification of Genes that are Associated with DNA Repeats in Prokaryotes", Molecular Microbiology, vol. 43, Issue 6, Apr. 25, 2002, 1565-1575.

Jiang, et al., "Degradation of Phage Transcripts by CRISPR-Associated RNases Enables Type III CRISPR-Cas Immunity", Cell, vol. 164, No. 4, Feb. 11, 2016, 710-721.

Jiang, et al., "RNA-guided Editing of Bacterial Genomes Using CRISPR-Cas Systems", Nature Biotechnology, vol. 31, Issue 3, Mar. 2013, 233-239.

Jinek, et al., "A Programmable Dual-RNA-Guided DNA Endonuclease in Adaptive Bacterial Immunity", Science, vol. 337, No. 6096, Aug. 17, 2012, 816-821.

Kabadi, et al., "Multiplex CRISPR/Cas9-based Genome Engineering from a Single Lenttiviral Vector", Nucleic Acids Research, vol. 42, No. 19, e147, 2014, 11 pages.

Kawai, et al., "Transformation of *Saccharomyces cerevisiae* and Other Fungi", Bioengineered Bugs, vol. 1, No. 6, Nov./Dec. 2010, 395-403.

Konermann, et al., "Genome-Scale Transcriptional Activation by an Engineered CRISPR-Cas9 Complex", Nature, vol. 517, Jan. 29, 2015, 583-588.

Konermann, et al., "Optical Control of Mammalian Endogenous Transcription and Epigenetic States", Nature, vol. 500, No. 7463, Aug. 22, 2013, 472-476.

(56) References Cited

OTHER PUBLICATIONS

Kurth, et al., "Virus-Derived Gene Expression and RNA Interference Vector for Grapevine", Journal of Virology, vol. 86, No. 11, Jun. 2012, 6002-6009.

Li, et al., "Targeted Plant Genome Editing via the CRISPR/Cas9 Technology", Plant Functional Genomics: Methods and Protocols, vol. 1284, Feb. 2015, 239-255.

Lowder, et al., "A CRISPR/Cas9 Toolbox for Multiplexed Plant Genome Editing and Transcriptional Regulation", Plant Physiology, vol. 169., Oct. 2015, 15 pages.

Ma, et al., "A Robust CRISPR/Cas9 System for Convenient, High-Efficiency Multiplex Genome Editing in Monocot and Dicot Plants", Molecular Plant, vol. 8, No. 8, Aug. 2015, 1274-1284.

Mackay, et al., "The Prospects for Designer Single-Stranded RNA-Binding Proteins", Nature Structural & Molecular Biology, vol. 18, No. 3, Mar. 2011, 256-261.

Makarova, et al., "An Updated Evolutionary Classification of CRISPR-Cas Systems", Nature Reviews Microbiology, vol. 13, Nov. 2015, 722-736.

Makarova, et al., "Annotation and Classification of CRISPR-Cas Systems", Methods in Molecular Biology, vol. 1311, 2015, 47-75.

Makarova, "Evolution and Classification of the CRISPR-Cas Systems", Nature Reviews Microbiology, vol. 9, No. 6, Jun. 2011, 467-477.

Marraffini, "CRISPR-Cas Immunity in Prokaryotes", Nature, vol. 526, Oct. 1, 2015, 55-62.

Miyazaki, et al., "Destabilizing Domains Derived from the Human Estrogen Receptor", Journal of the American Chemical Society, vol. 134, No. 9, 2012, 3942-3945.

Mojica, et al., "Intervening Sequences of Regularly Spaced Prokaryotic Repeats Derive from Foreign Genetic Elements", Journal of Molecular Evolution, vol. 60, No. 2, Mar. 2005, 174-182.

Mojica, et al., "MicroCorrespondence: Biological significance of a family of regularly spaced repeats in the genomes of Archaea, Bacteria and mitochondria", Molecular Microbiology, vol. 36, No. 1, 2000, 244-246.

Morrell, et al., "Crop Genomics: Advances and Applications", Nature Reviews Genetics, vol. 13, Feb. 2012, 85-96.

Nekrasov, et al., "Plant Genome Editing Made Easy: Targeted Mutagenesis In Model and Crop Plants Using the CRISPR/Cas System", Plant Methods, vol. 9, No. 39, 2013, 10 pages.

Nicolaou, et al., "Molecular Diagnosis of Peanut and Legume Allergy", Current Opinion in Allergy and Clinical Immunology, vol. 11, No. 3, Apr. 2011, 222-228.

Zhou, et al., "Exploiting SNPs for Biallelic CRISPR Mutations in the Outcrossing Woody Perennial Populus Reveals 4-coumarate:CoA ligase Specificity and Redundancy", New Phytologist, vol. 208, 2015, 298-301.

Nishimasu, et al., "Crystal Structure of Cas9 in Complex with Guide RNA and Target DNA", Cell, vol. 156, No. 5, Feb. 27, 2014, 935-949.

Nishimasu, et al., "Crystal Structure of Staphylococcus aureus Cas9", Cell, vol. 162, No. 5, Aug. 27, 2015, 1113-1126.

Nunez, et al., "Integrase-Mediated Spacer Acquisition During CRISPR-Cas Adaptive Immunity", Nature, vol. 519, Mar. 2015, 193-198.

Parnas, et al., "A Genome-Wide CRISPR Screen in Primary Immune Cells to Dissect Regulatory Networks", Cell, vol. 162, No. 3, Jul. 30, 2015, 675-686.

Peng, et al., "An Archaeal CRISPR Type III-B System Exhibiting Distinctive RNA Targeting Features and Mediating Dual RNA and DNA Interference", Nucleic Acids Research, vol. 43, No. 1, 2014, 406-417.

Petersen, "Towards Precisely Glyco Engineered Plants", Plant Biotech Denmark, Annual Meeting, Jan. 28-29, 2015, 2015, 2 pages.

Platt, et al., "CRISPR-Cas9 Knockin Mice for Genome Editing and Cancer Modelling", Cell, vol. 159, No. 2, Oct. 9, 2014, 440-455.

Price, et al., "Cas9-Mediated Targeting of Viral RNA in Eukaryotic Cells", Proceedings of the National Academy of Sciences, vol. 112, No. 19, May 12, 2015, 6164-6169.

Ramakrishna, et al., "Gene Disruption by Cell-Penetrating Peptide-Mediated Delivery of Cas9 Protein and Guide RNA", Genome Research, vol. 24, No. 6, Jun. 2014, 1020-1027.

Ramanan, et al., "CRISPR/Cas9 Cleavage of Viral DNA Efficiently Suppresses Hepatitis B Virus", Scientific Reports, vol. 5, Article No. 10833, 2015, 9 pages.

Ran, et al., "Double Nicking by RNA-Guided CRISPR Cas9 for Enhanced Genome Editing Specificity", Cell, vol. 154, No. 6, Sep. 12, 2013, 1380-1389.

Ran, et al., "Genome Engineering using the CRISPR-Cas9 System", Nature Protocols, vol. 8, No. 11, Nov. 2013, 2281-2308.

Ran, et al., "In Vivo Genome Editing Using Staphylococcus aureus Cas9", Nature, vol. 520, No. 7546, Apr. 9, 2015, 186-191.

Rodriguez, et al., "Targeted Chemical-Genetic Regulation of Protein Stability In Vivo", Chemistry & Biology, vol. 19, No. 3, Mar. 23, 2012, 391-398.

Shalem, et al., "Genome-Scale CRISPR-Cas9 Knockout Screening in Human Cells", Science, vol. 343, No. 6166, Jan. 3, 2014, 84-87.

Shalem, et al., "High-Throughput Functional Genomics Using CRISPR-Cas9", Nature Reviews Genetics, vol. 16, No. 5, May 2015, 299-311.

Shan, et al., "Targeted Genome Modification of Crop Plants using a CRISPR-Cas System", Nature biotechnology, vol. 31, Issue 8, Aug. 2013, 686-688.

Smith, et al., "A Directed Approach for Engineering Conditional Protein Stability Using Biologically Silent Small Molecules", The Journal Of Biological Chemistry, vol. 282, No. 34, Aug. 24, 2007, 24866-24872.

Staals, et al., "RNA Targeting by the Type III-A CRISPR-Cas Csm Complex of Thermus thermophilus", Molecular Cell, vol. 56, Issue 4, Nov. 20, 2014, 518-530.

Staals, et al., "Structure and Activity of the RNA-Targeting Type III-B CRISPR-Cas Complex of Thermus Thermophilus", Molecular Cell, vol. 52, No. 1, Oct. 10, 2013, 135-145.

Stovicek, et al., "CRISPR-Cas System Enables Fast and Simple Genome Editing of Industrial Saccharomyces cerevisiae Strains", Metabolic Engineering Communications, vol. 2, Dec. 2015, 13-22.

Sugano, et al., "CRISPR/Cas9-Mediated Targeted Mutagenesis in the Liverwort Marchantia polymorpha L.", Plant and Cell Physiology, vol. 55, 2014, 475-481.

Swiech, et al., "In Vivo Interrogation of Gene Function in the Mammalian Brain Using CRISPR-Cas9", Nature Biotechnology, vol. 33, No. 1, Oct. 19, 2014, 102-106.

Tamulaitis, et al., "Programmable RNA Shredding by the Type III-A CRISPR-Cas System of Streptococcus thermophilus", Molecular Cell, vol. 56, Issue 4, Nov. 20, 2014, 506-517.

Tsai, et al., "Dimeric CRISPR RNA-Guided FokI Nucleases for Highly Specific Genome Editing", Nature Biotechnology, vol. 32, No. 6, 2014, 569-577.

Van Der Oost, et al., "CRISPR-Based Adaptive and Heritable Immunity in Prokaryotes", Trends in Biochemical Sciences, vol. 34, Issue 8, Aug. 2009, 401-407.

Van Embden, et al., "Genetic Variation and Evolutionary Origin of the Direct Repeat Locus of Mycobacterium tuberculosis Complex Bacteria", J. Bacteriology, vol. 182, No. 9, May 2000, 2393-2401.

Wang, et al., "Genetic Screens in Human Cells Using the CRISPR/Cas9 System", Science, vol. 343, No. 6166, Jan. 3, 2014, 80-84.

Wang, et al., "One-Step Generation of Mice Carrying Mutations in Multiple Genes by CRISPR/Cas-Mediated Genome Engineering", Cell, vol. 153, No. 4, May 9, 2013, 910-918.

Woo, et al., "DNA-Free Genome Editing in Plants with Preassembled CRISPR-Cas9 Ribonucleoproteins", Nature Biotechnology, vol. 33, No. 11, Nov. 2015, 1162-1164.

Wright, et al., "Biology and Applications of CRISPR Systems: Harnessing Nature's Toolbox for Genome Engineering", Cell, vol. 164, Issues 1-2, Jan. 14, 2016, 29-44.

Wu, et al., "Genome-Wide Binding of the CRISPR Endonuclease Cas9 in Mammalian Cells", Nature Biotechnology, vol. 32, No. 7, Jul. 2014, 670-676.

Xie, et al., "RNA-Guided Genome Editing in Plants Using a CRISPR-Cas System", Molecular Plant, vol. 6, No. 6, Nov. 2013, 1975-1983.

(56) References Cited

OTHER PUBLICATIONS

Xing, et al., "A CRISPR/Cas9 Toolkit for Multiplex Genome Editing in Plants", BMC Plant Biology, vol. 14, No. 327, 2014, 1-12.

Xu, et al., "Gene Targeting Using the Agrobacterium Tumefaciens-Mediated CRISPR-Cas System in Rice", Rice, vol. 7, No. 5, 2014, 1-4.

Xu, et al., "Sequence Determinants of Improved CRISPR SgRNA Design", Genome Research, vol. 25, No. 8, Aug. 2015, 1147-1157.

Yin, et al., "A Geminivirus-Based Guide RNA Delivery System for CRISPR/Cas9 Mediated Plant Genome Editing", Scientific Reports 5, Article No. 14926, Oct. 9, 2015, 10 pages.

Yosef, et al., "Proteins and DNA Elements Essential for the CRISPR Adaptation Process In *Escherichia coli*", Nucleic Acids Research, vol. 40, Issue 12, Jul. 2012, 5569-5576.

Zetsche, et al., "A split-Cas9 architecture for inducible genome editing and transcription modulation", Nature biotechnology, vol. 33, No. 2, 2015, 139-142.

Zetsche, et al., "Cpf1 is a Single RNA-Guided Endonuclease of a Class 2 CRISPR-Cas System", Cell, vol. 163, Sep. 25, 2015, 759-771.

Zhang, et al., "Structure and Mechanism of the CMR Complex for CRISPR-Mediated Antiviral Immunity", Molecular Cell, vol. 45, No. 3, Feb. 10, 2012, 303-313.

\* cited by examiner

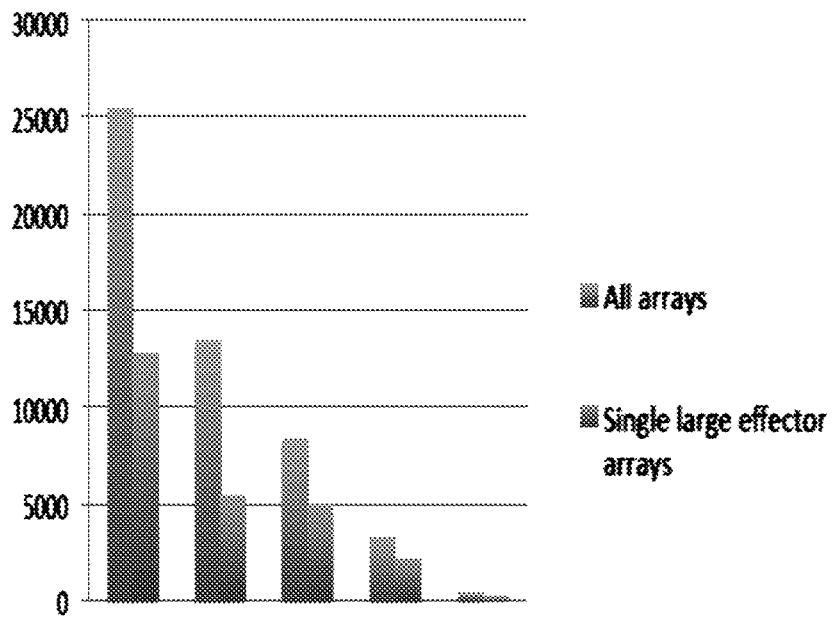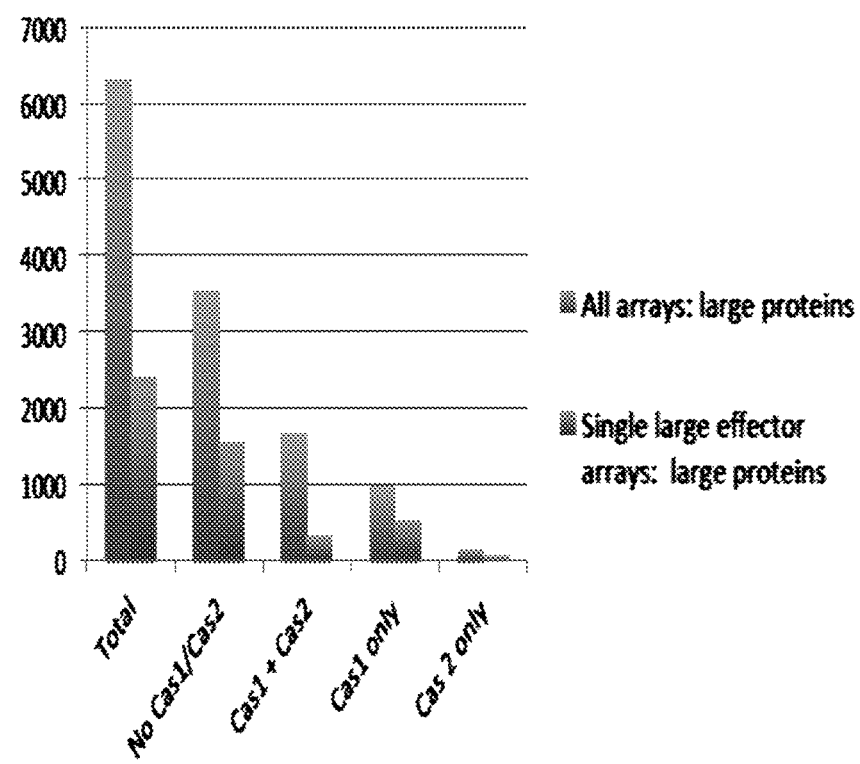
FIG. 2

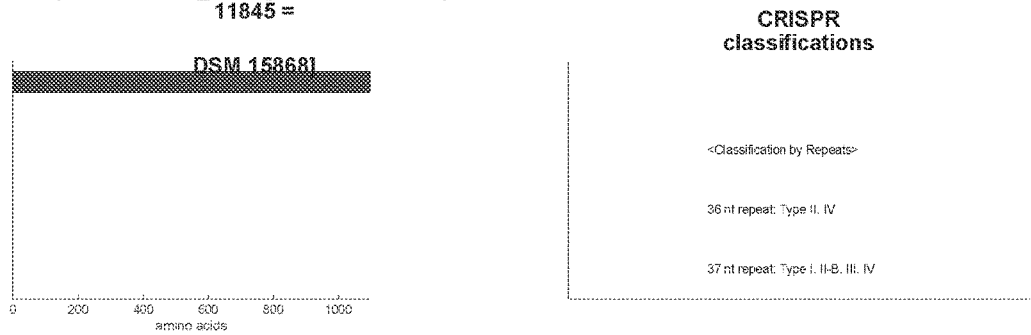
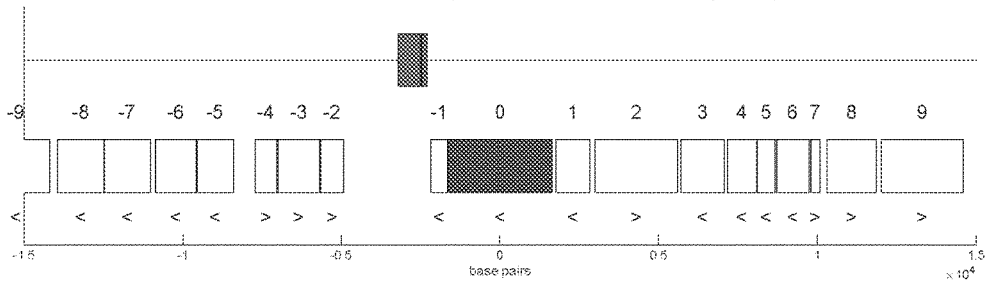
FIG. 4C

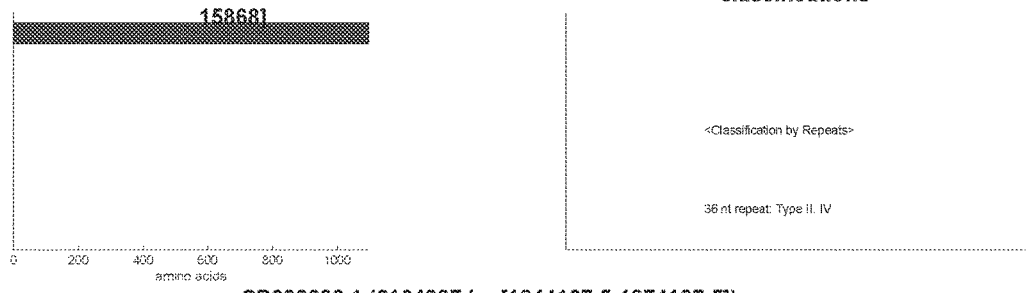
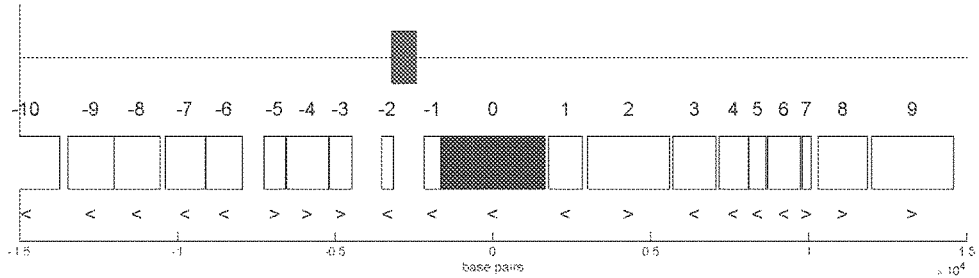
FIG. 4G

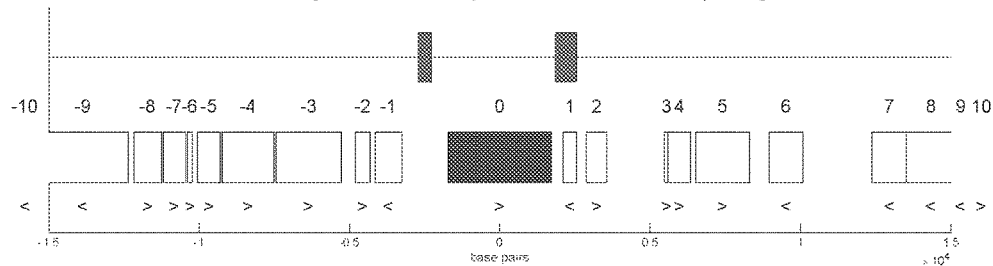
FIG. 4I

EFT35596.1 (1096 aa):
hypothetical protein RAYM_05191 [Riemerella anatipestifer RA-YM]

CRISPR classifications

<Classification by Repeats>

36 nt repeat: Type II, IV

AENH01000026.1 (219800 bp [188684.5-218684.5]):
DEFINITION Riemerella anatipestifer RA-YM scaffold6, whole genome shotgun

CRISPR arrays in genome

| Dist | # | Repeat | Spacer | Consensus |
|---|---|---|---|---|
| 972 | 10 | 36 | 30 | GTTGGGACTGCTCTCATTTTGAAGGGTATTCACAAC |

Genes nearby protein

| Index | Protein | Protein Length | Protein Name |
|---|---|---|---|
| -9 | EFT35587.1 | 856 | hypothetical protein |
| -8 | EFT35588.1 | 519 | ribonuclease G |
| -7 | EFT35589.1 | 97 | DNA-binding protein HU |
| -6 | EFT35590.1 | 346 | A/G-specific adenine glycosylase |
| -5 | EFT35591.1 | 187 | GidD |
| -4 | EFT35592.1 | 306 | Ribokinase |
| -3 | EFT35593.1 | 455 | PpiC-type peptidyl-prolyl cis-trans isomerase |
| -2 | EFT35594.1 | 867 | alanyl-tRNA synthetase |
| -1 | EFT35595.1 | 349 | Glucokinase |
| 0 | EFT35596.1 | 1095 | hypothetical protein |
| 1 | EFT35597.1 | 178 | hypothetical protein |
| 2 | EFT35598.1 | 239 | hypothetical protein |
| 3 | EFT35599.1 | 442 | Hep_Hag family protein |
| 4 | EFT35600.1 | 228 | hypothetical protein |
| 5 | EFT35601.1 | 387 | homogentisate 1,2-dioxygenase |
| 6 | EFT35602.1 | 426 | 4-hydroxybutyrate coenzyme A transferase |
| 7 | EFT35603.1 | 482 | asparaginyl-tRNA synthetase |
| 8 | EFT35604.1 | 489 | RNA polymerase sigma-54 factor rpoN |
| 9 | EFT35605.1 | 705 | TonB-dependent outer membrane receptor |

FIG. 4AA

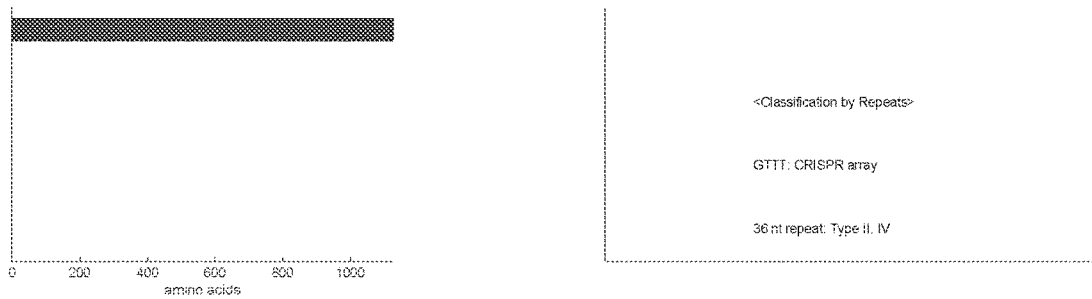
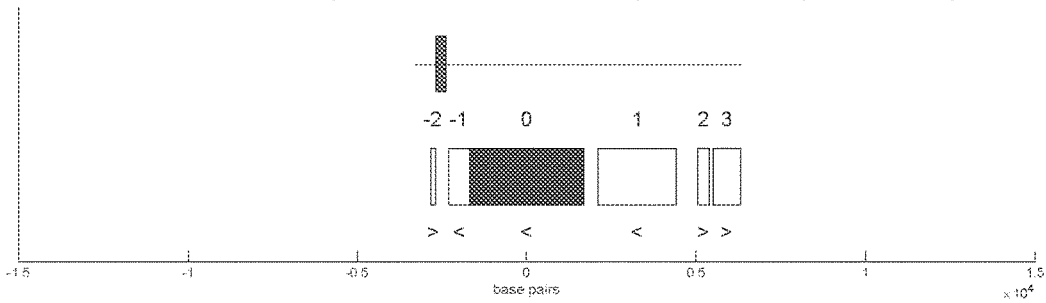
FIG. 4CC

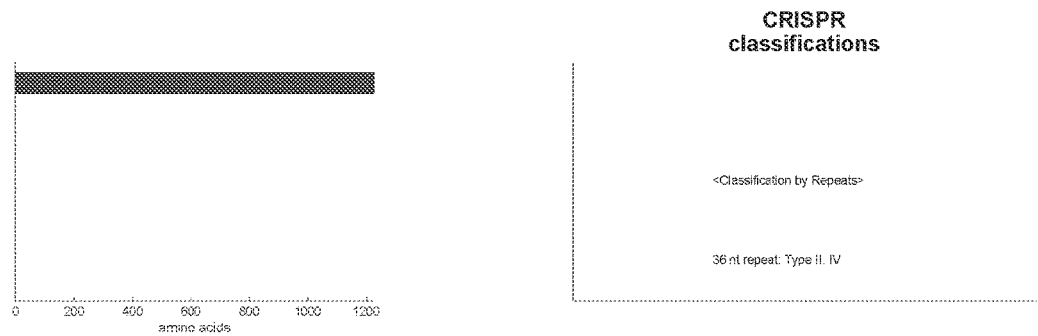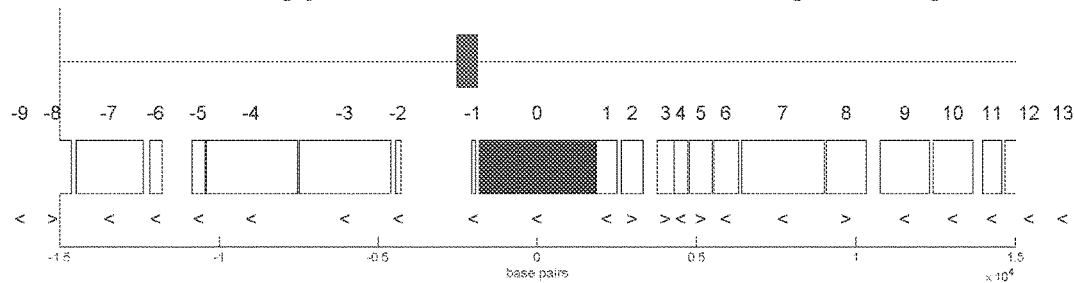
FIG. 4HH

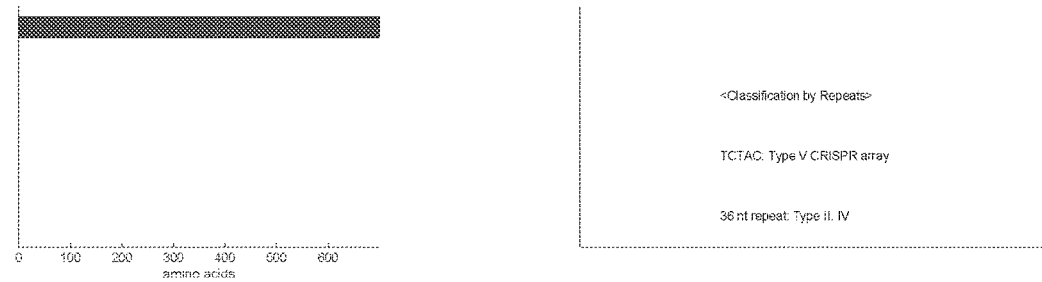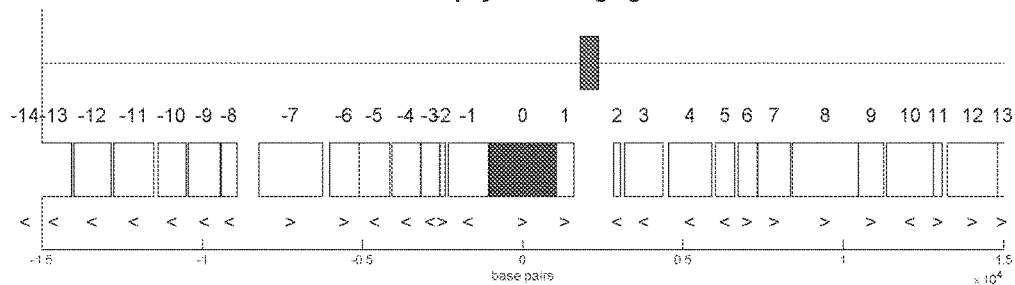
FIG. 4JJ

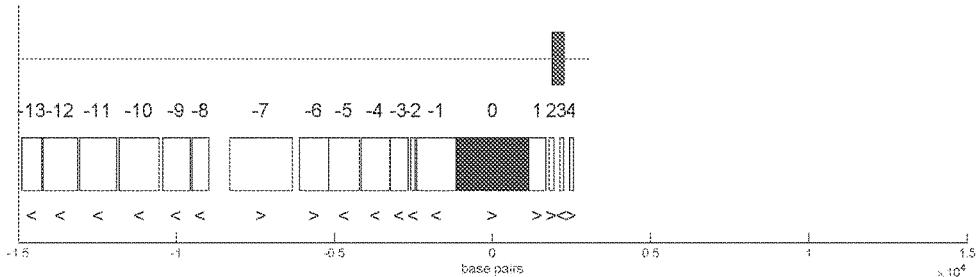
FIG. 4LL

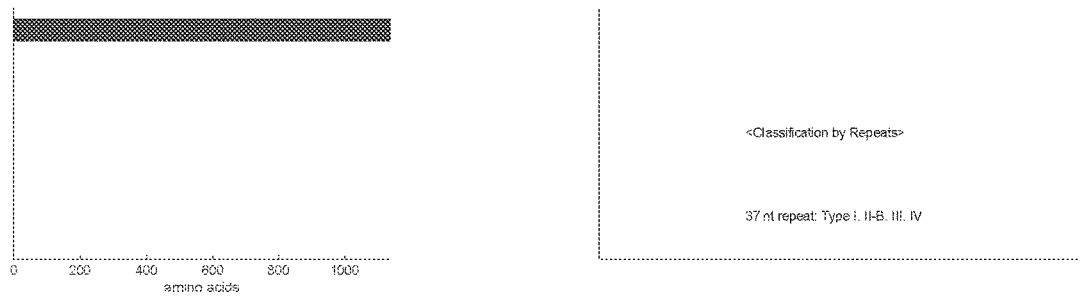
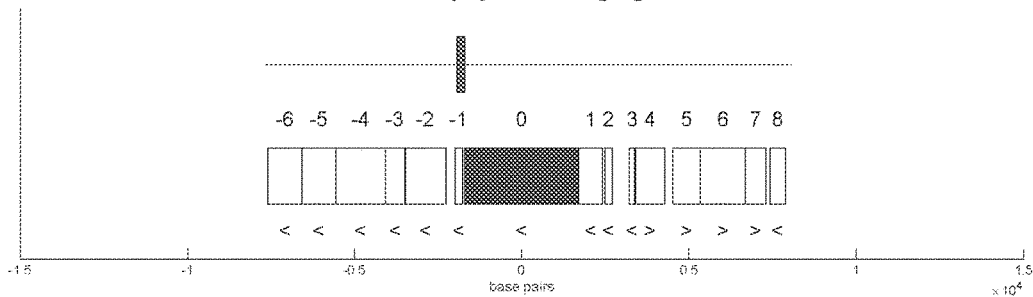
FIG. 4MM

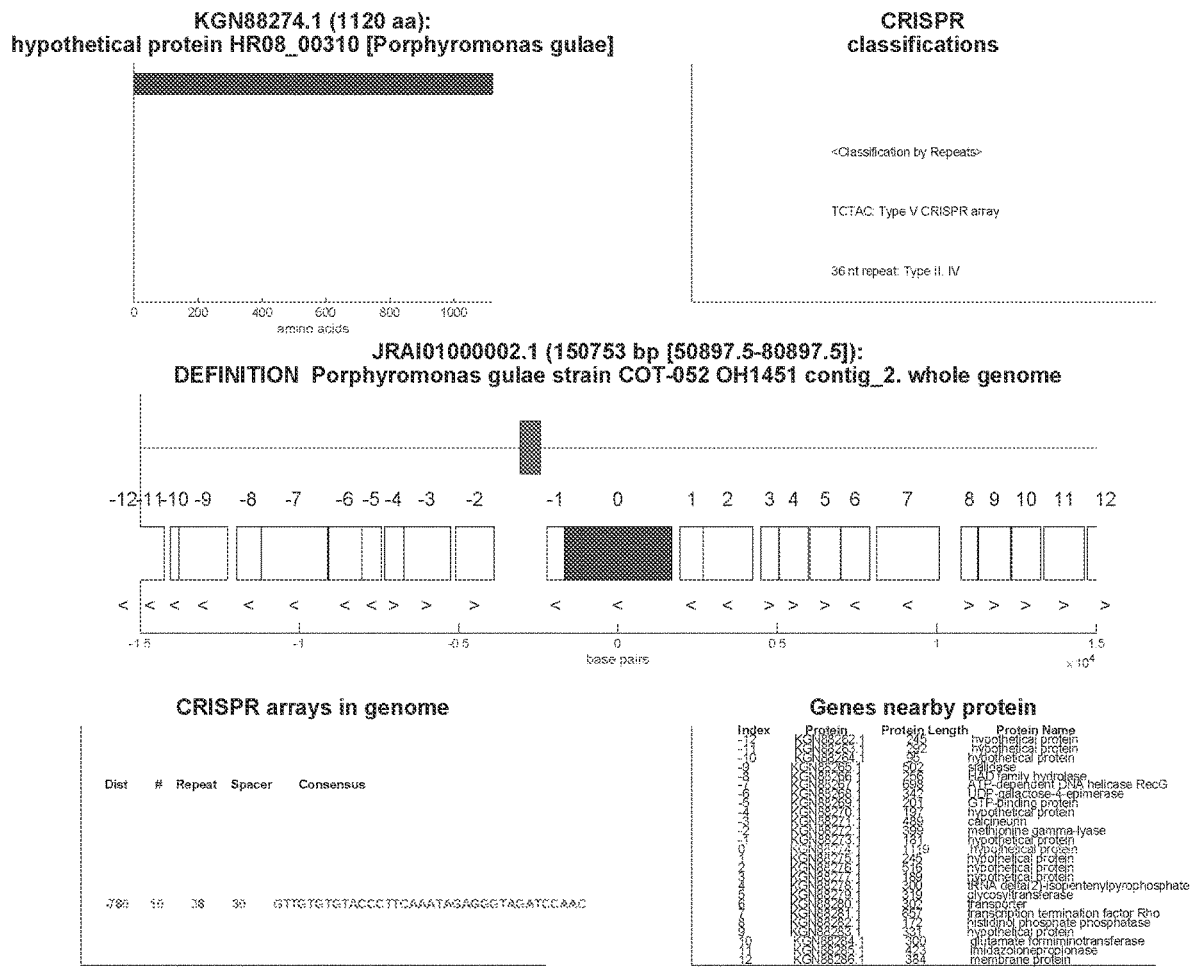
FIG. 4AAA

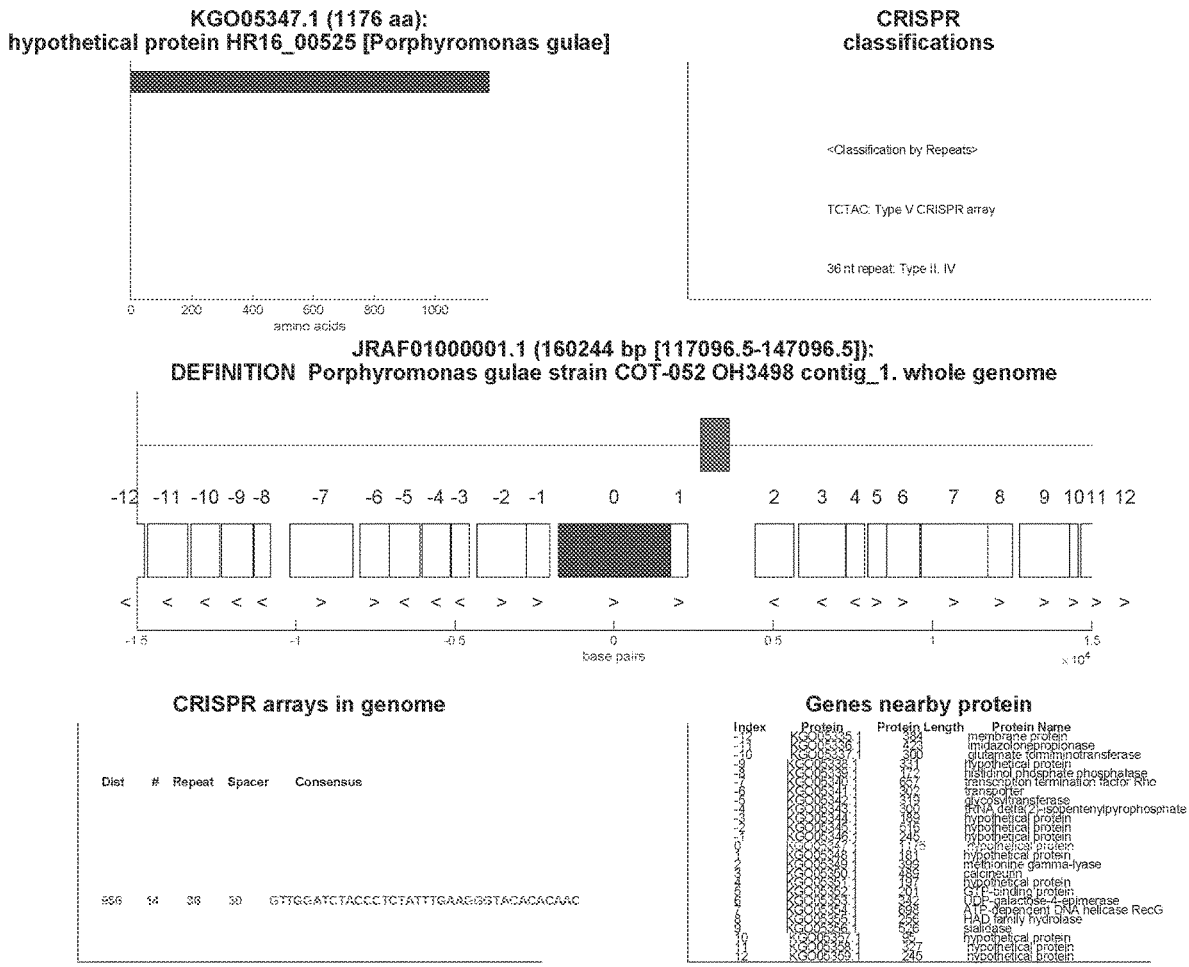
FIG. 4BBB

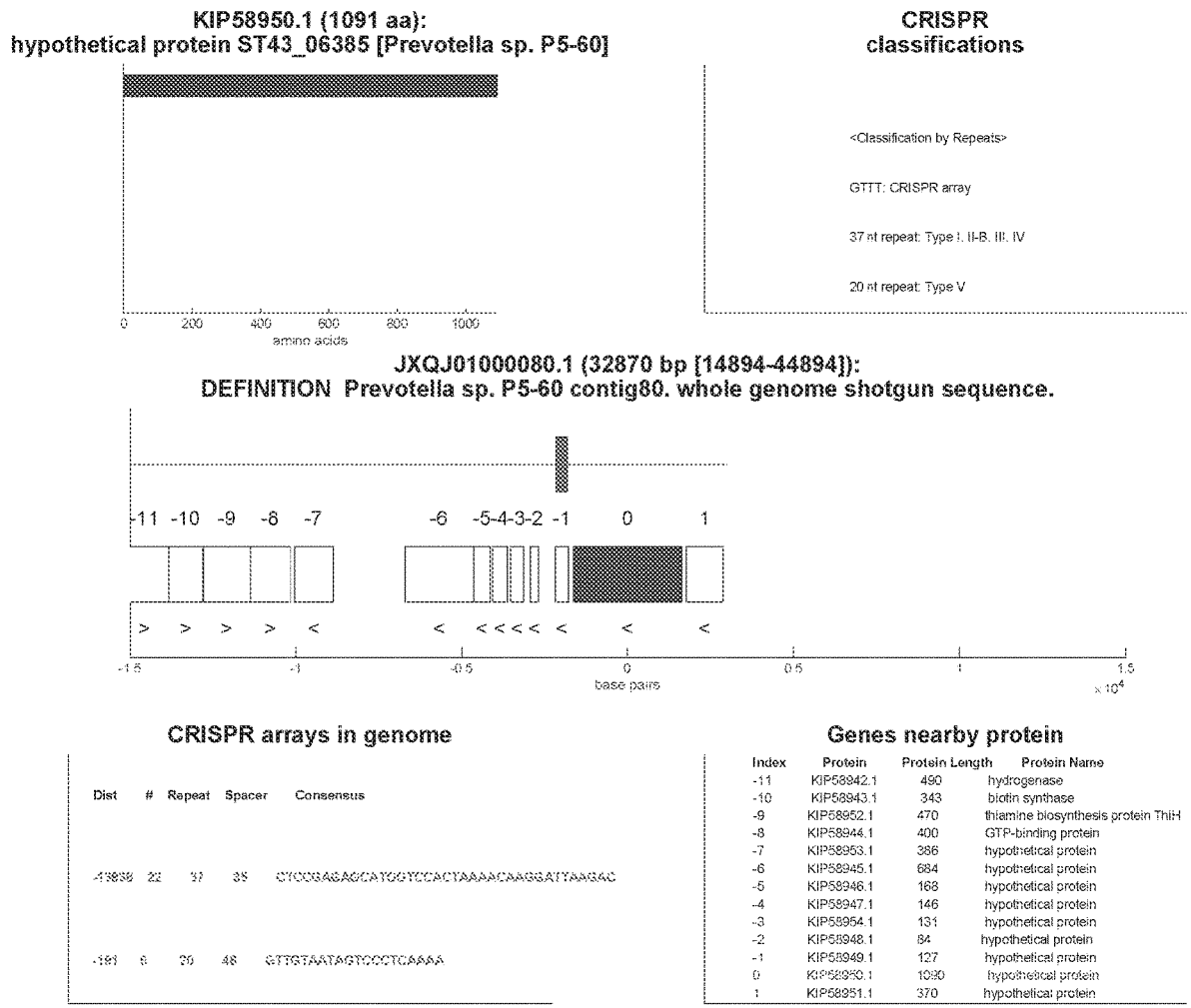
FIG. 4CCC

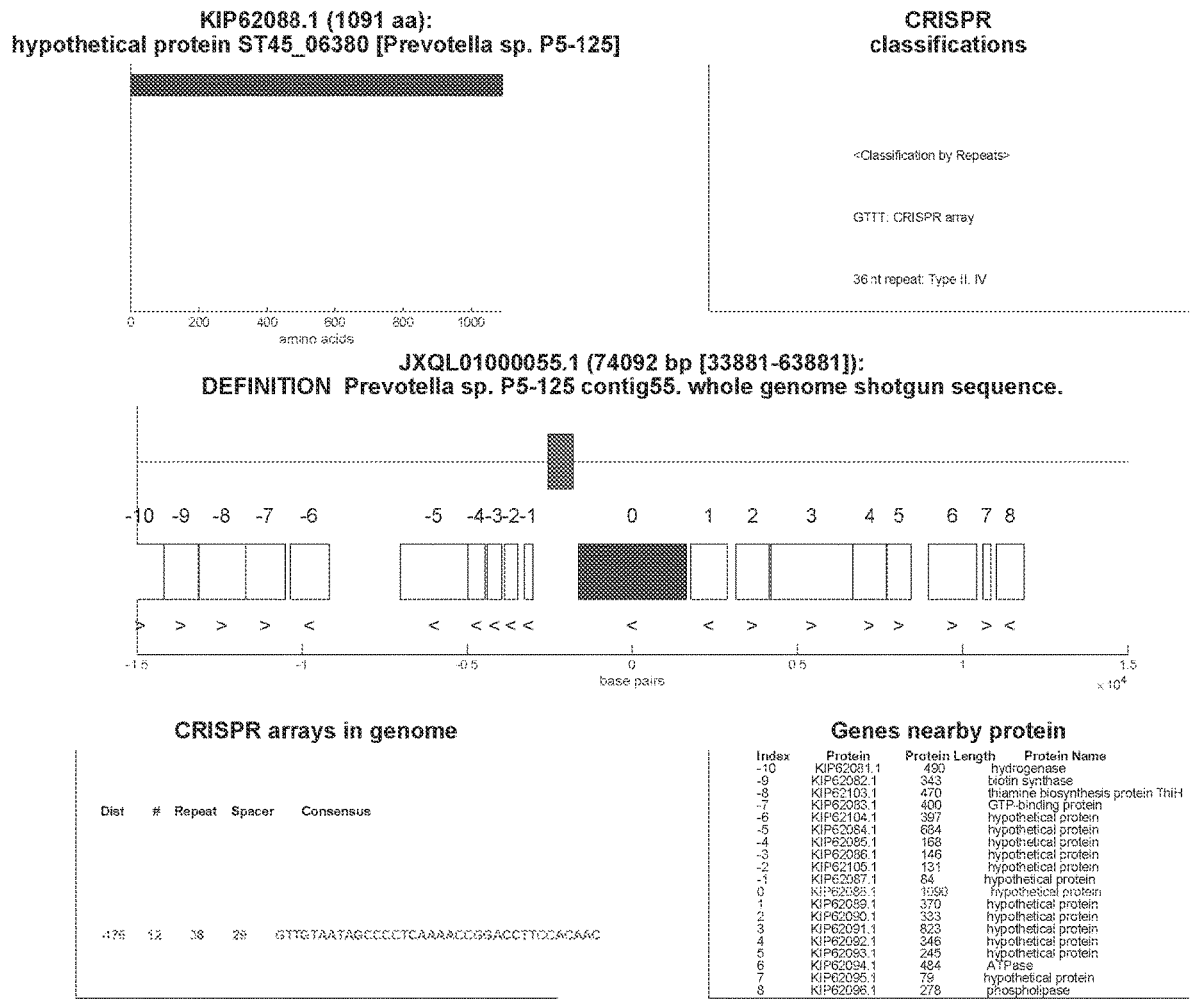
FIG. 4DDD

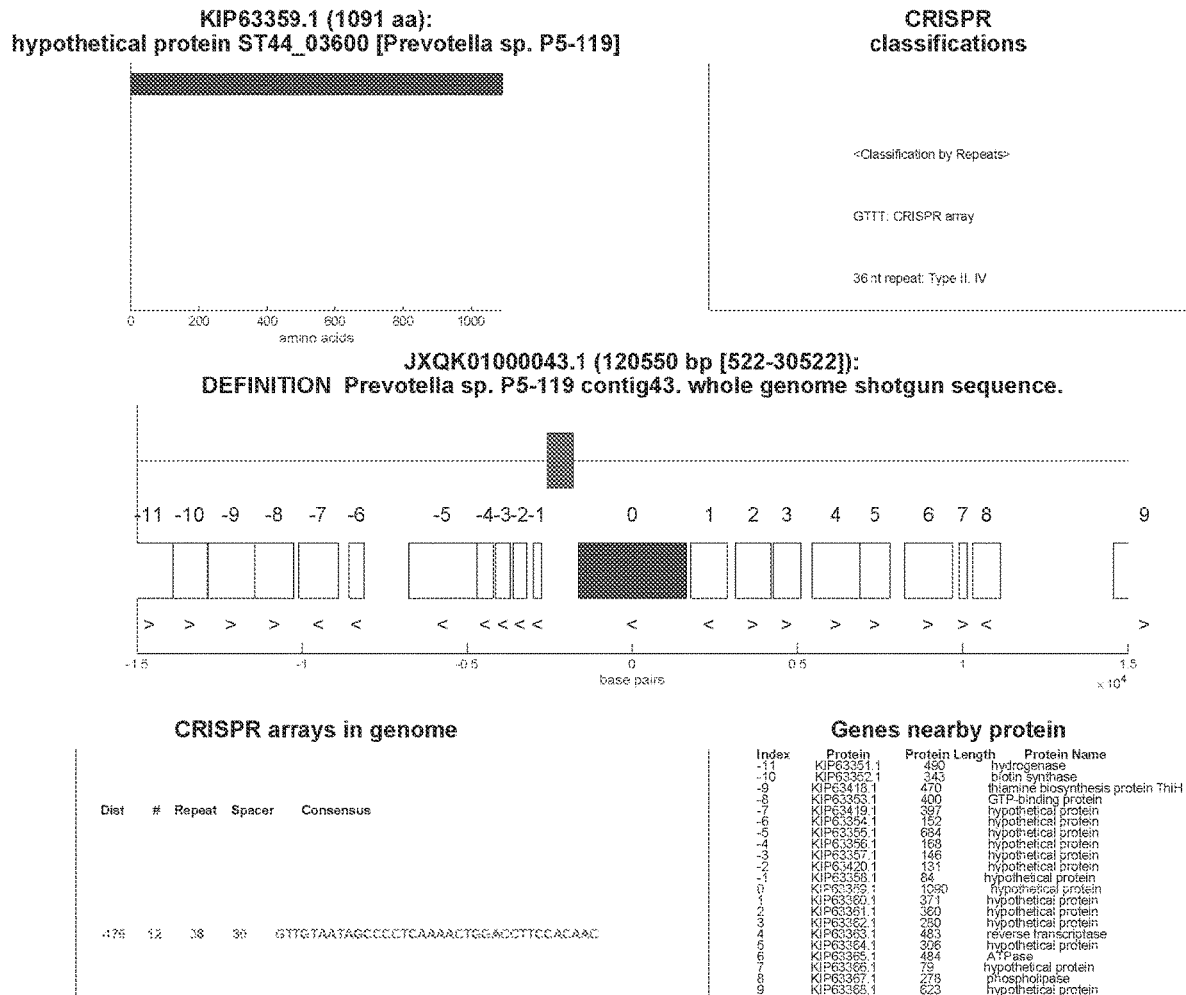
FIG. 4EEE

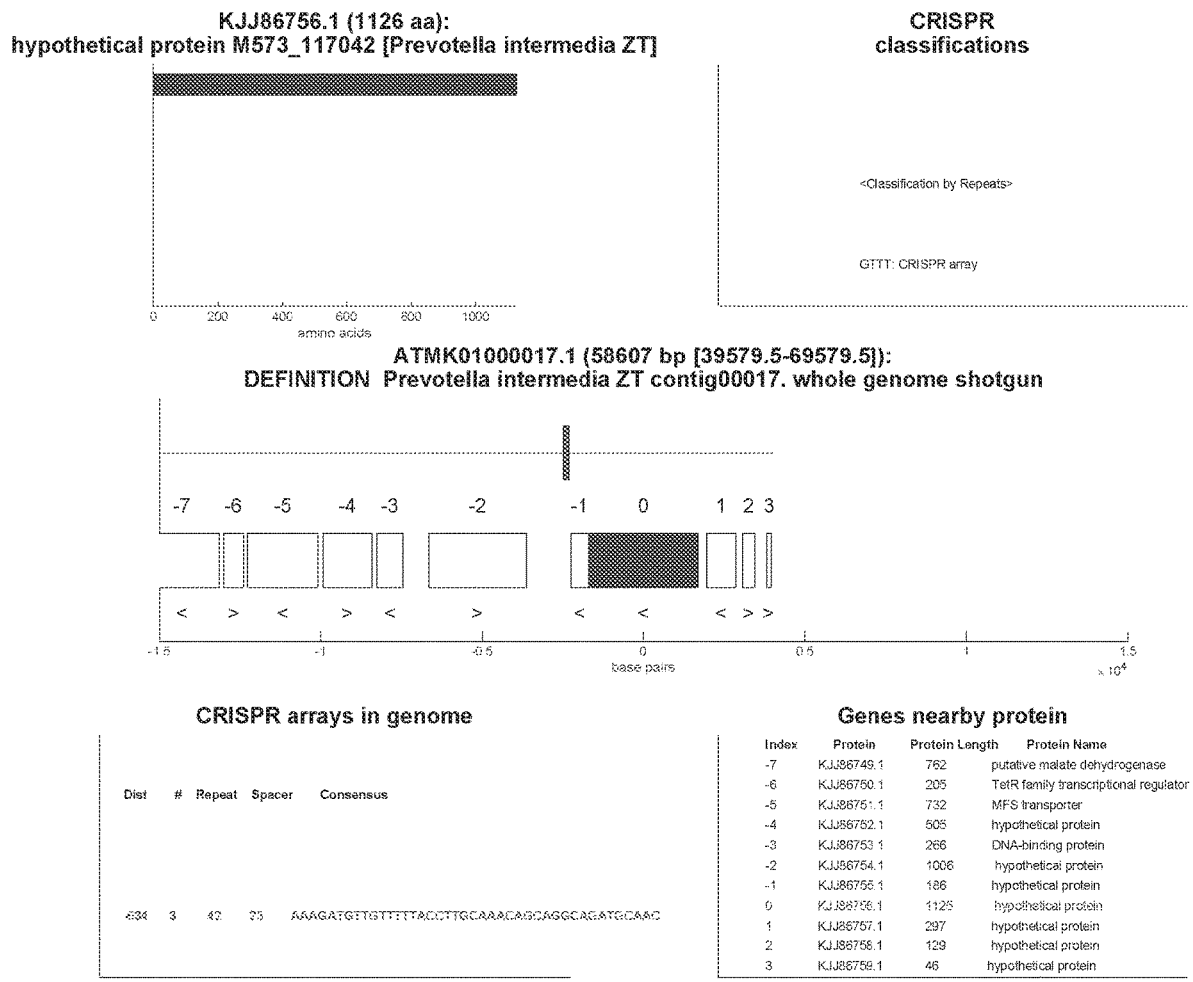
FIG. 4FFF

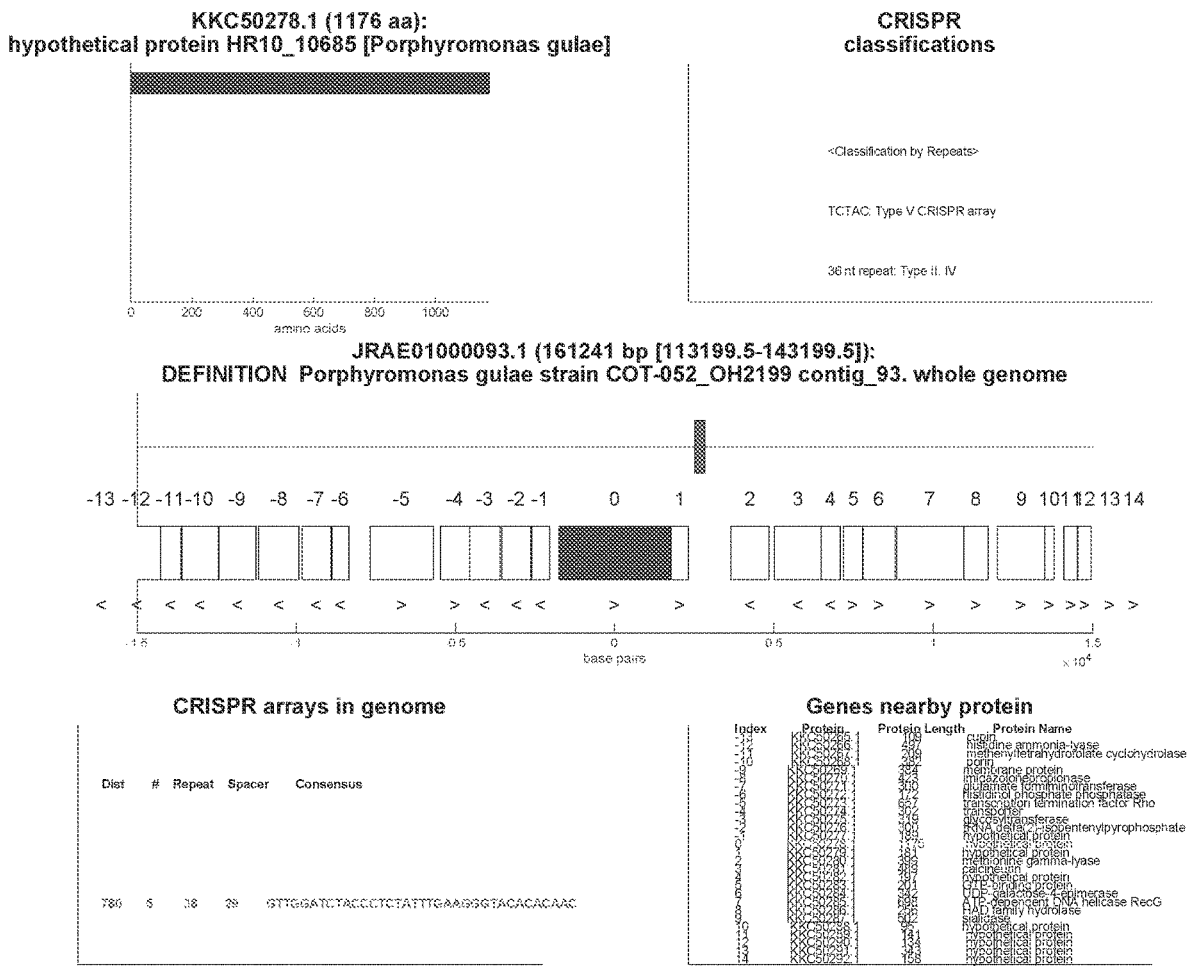
FIG. 4GGG

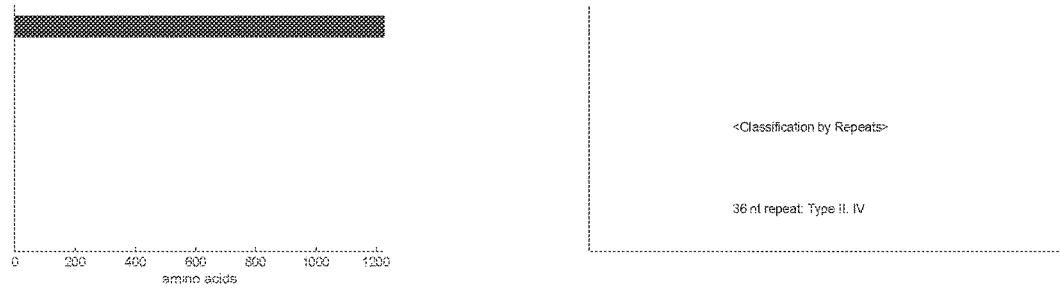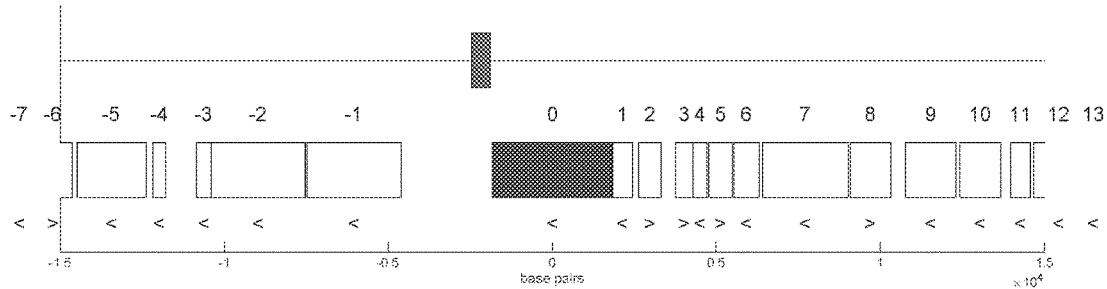
FIG. 4HHH

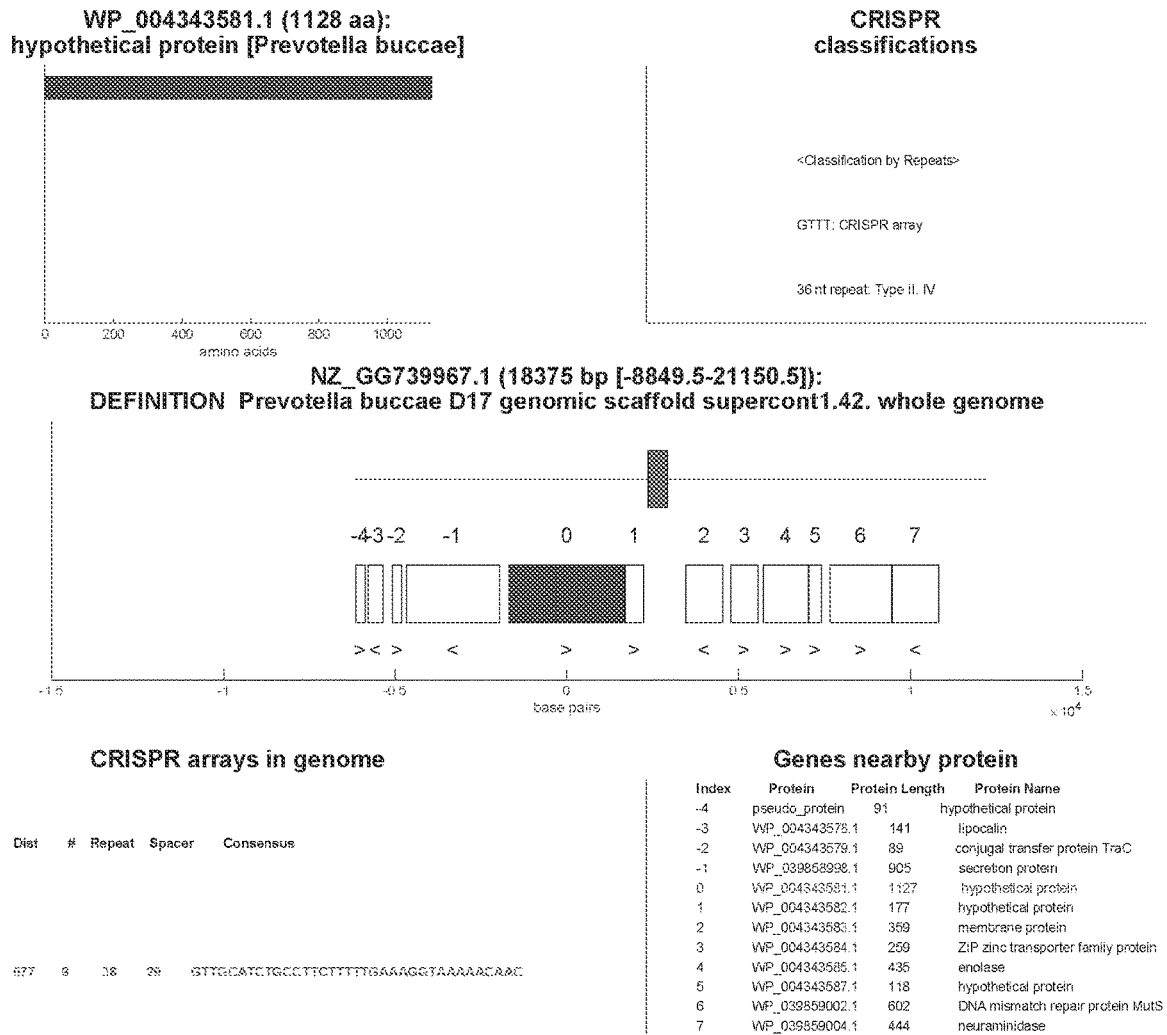
FIG. 4III

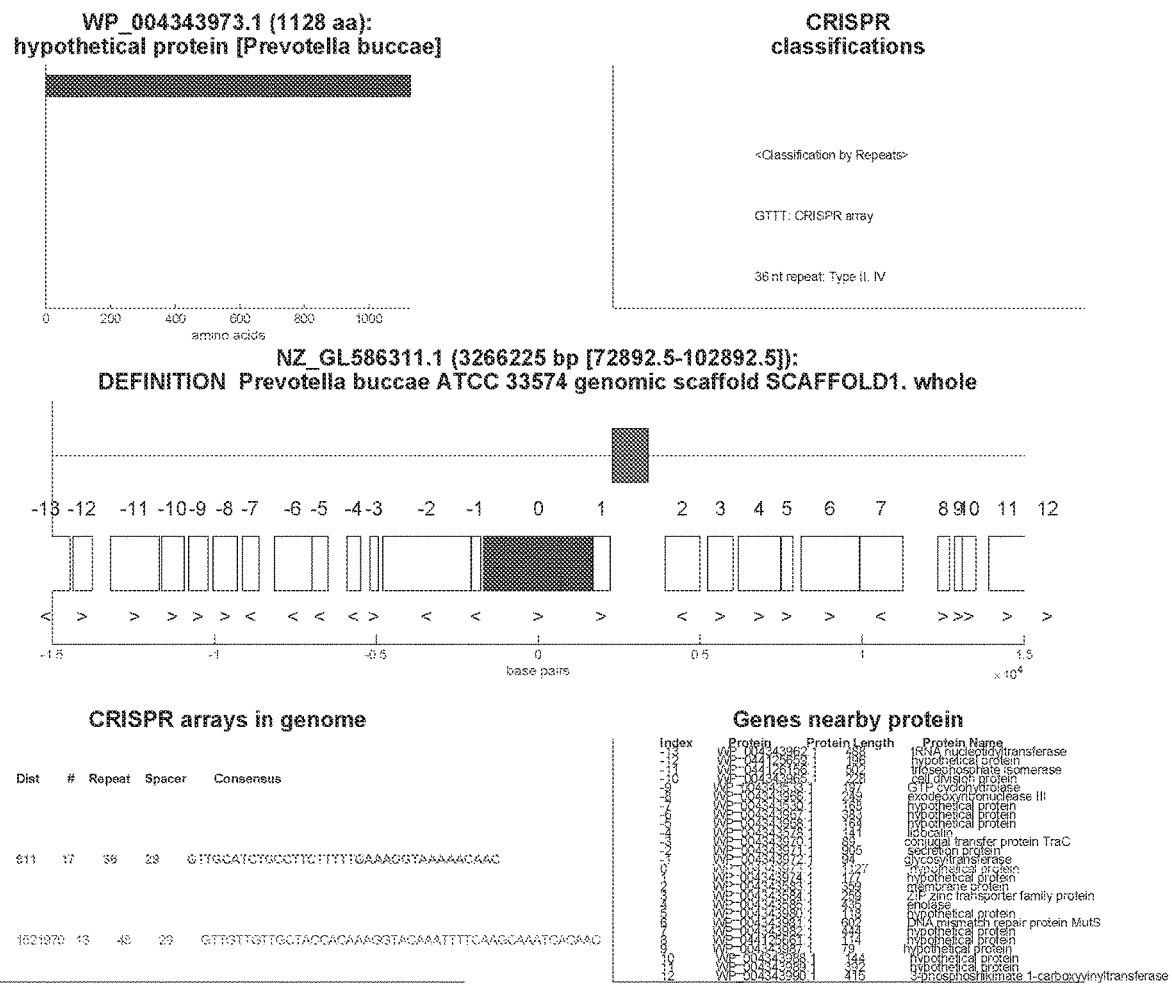
FIG. 4JJJ

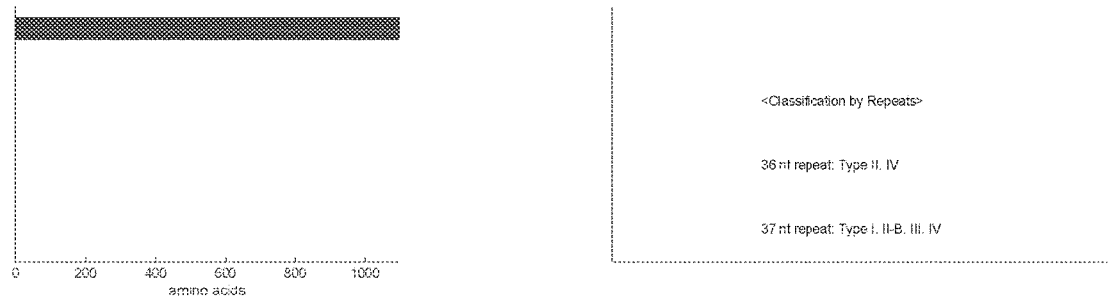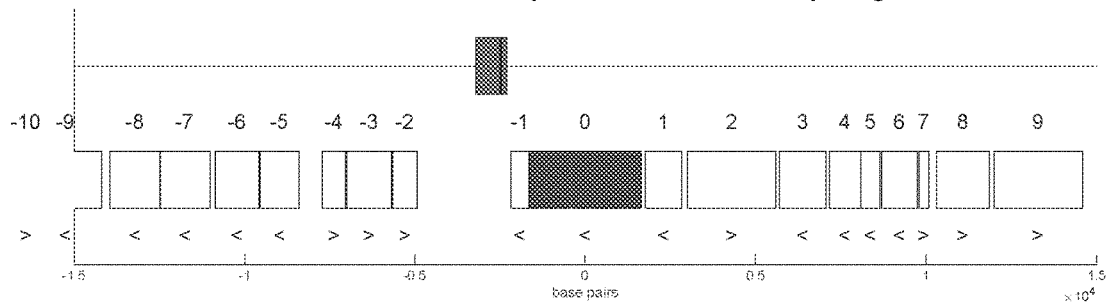
FIG. 4KKK

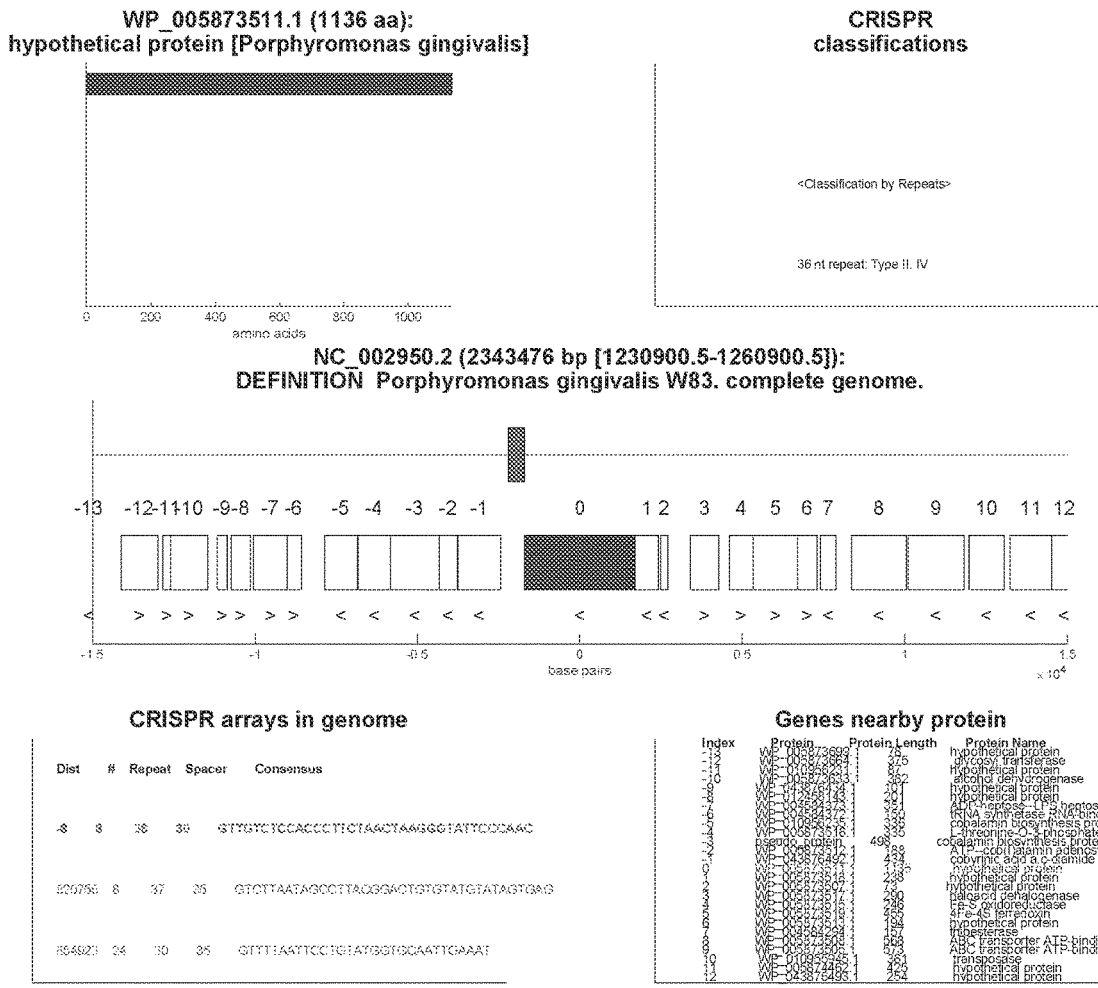
FIG. 4LLL

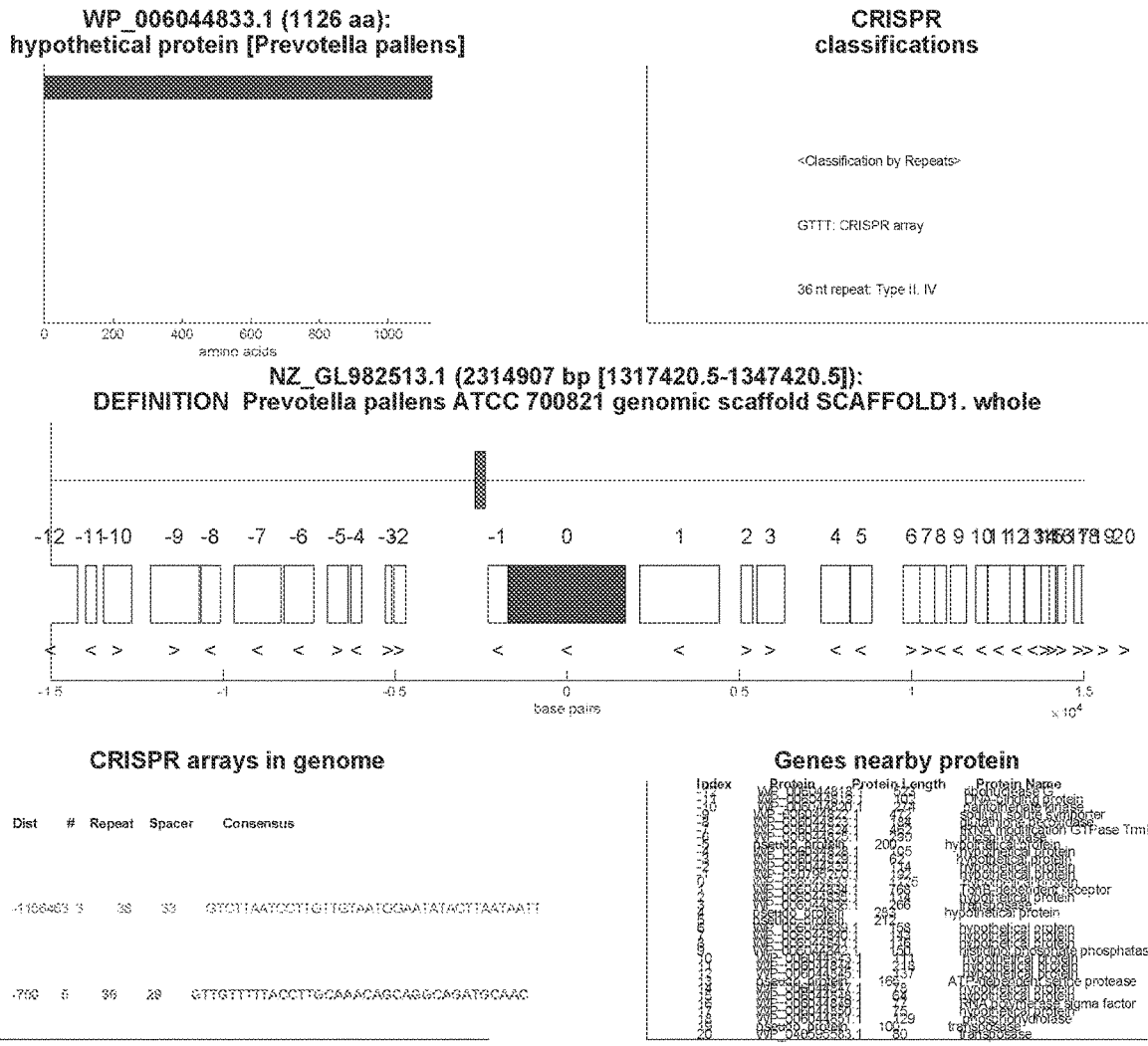
FIG. 4MMM

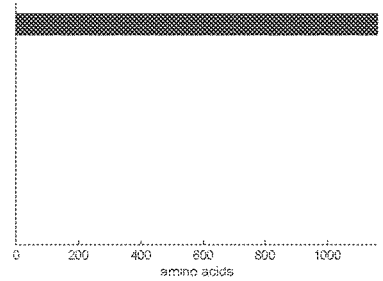
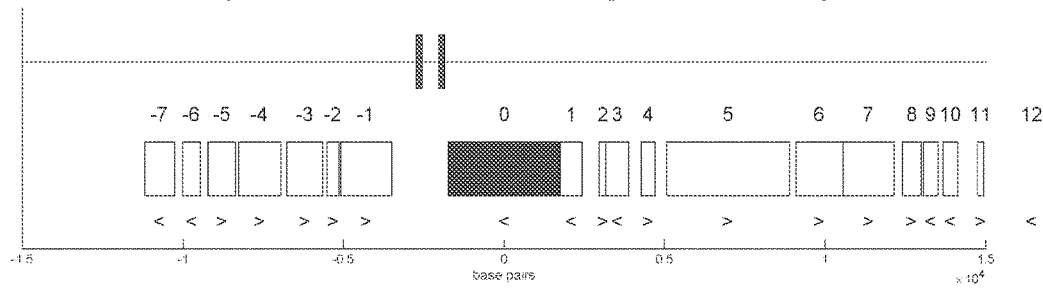
FIG. 4NNN

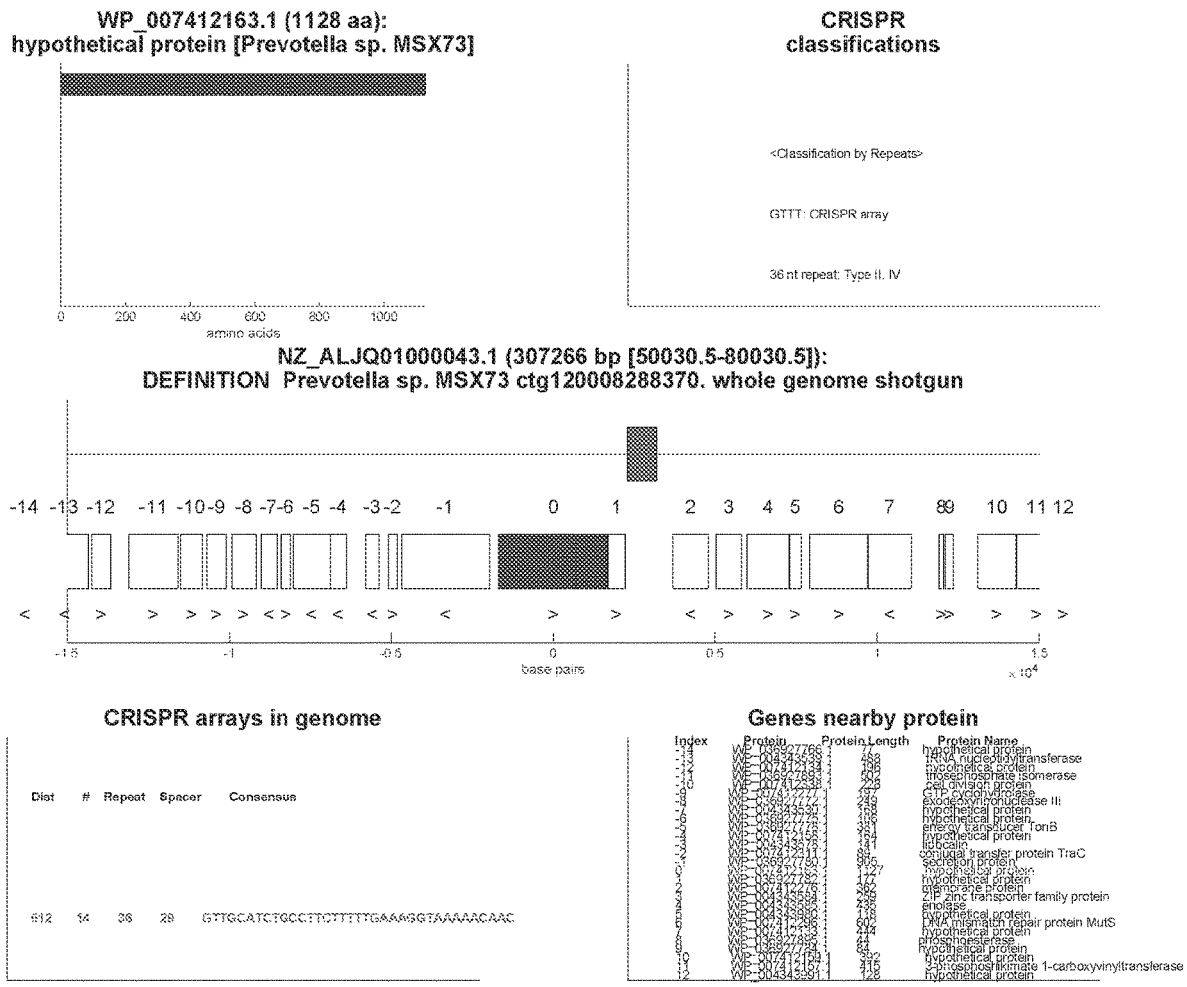
FIG. 4000

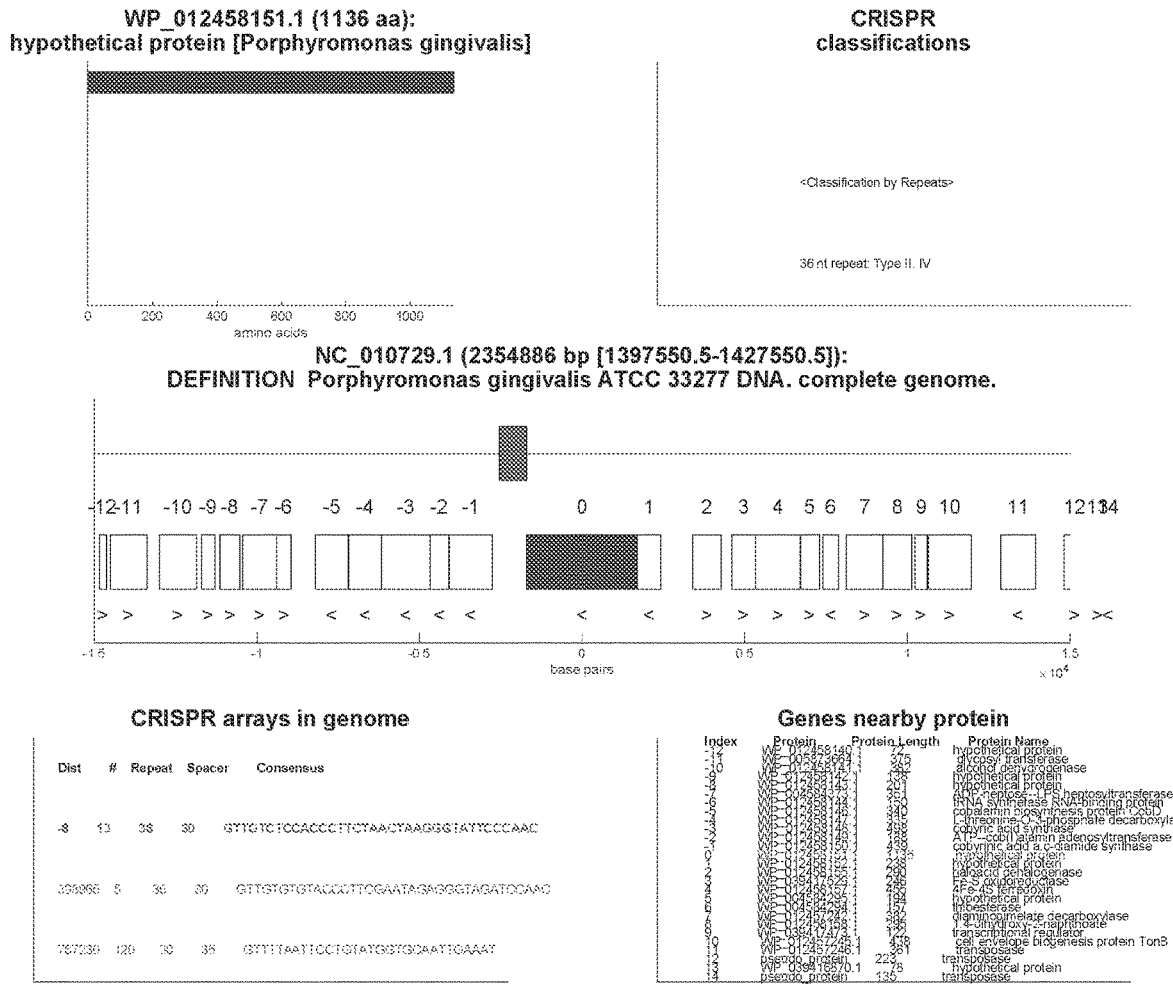
FIG. 4PPP

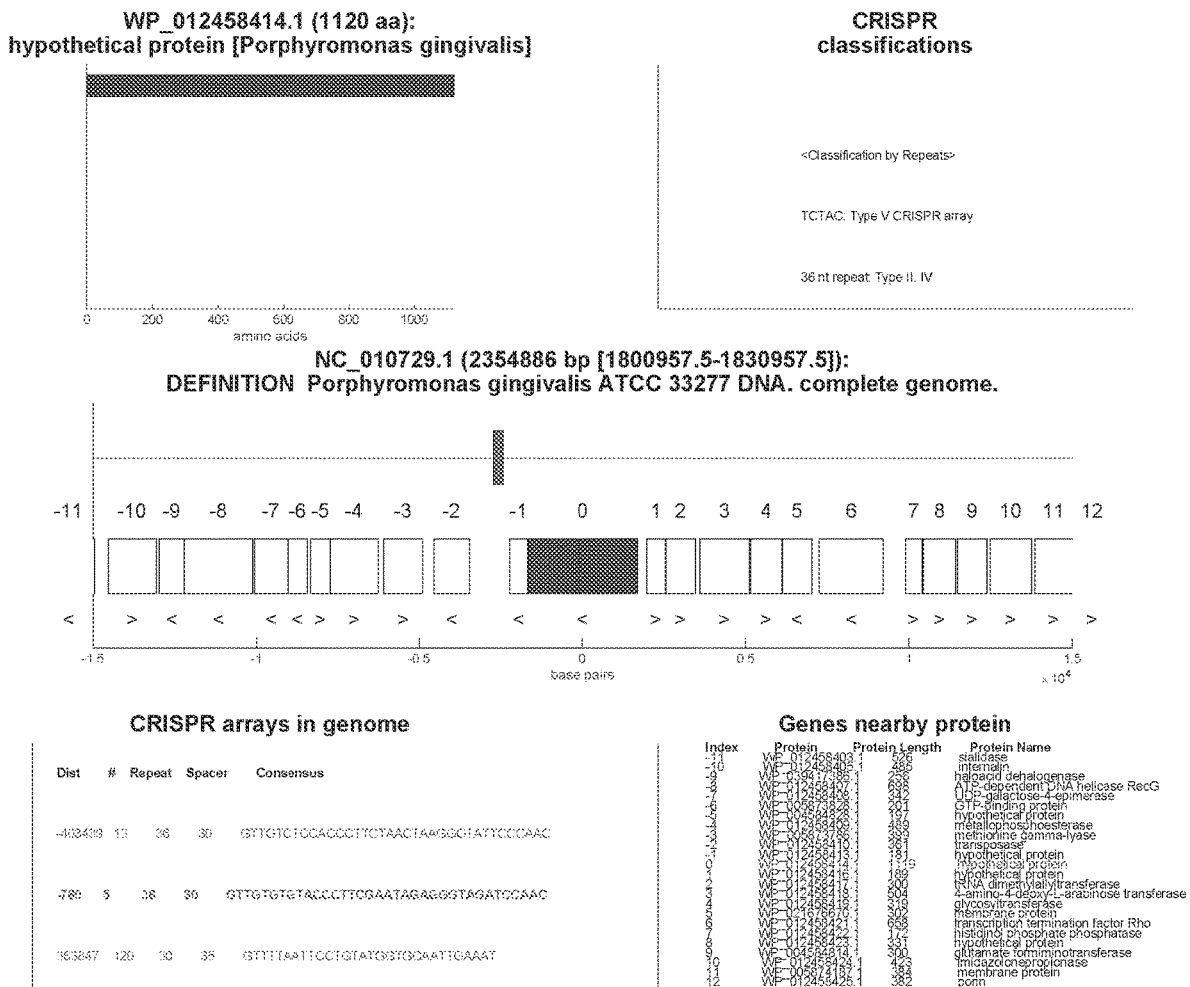
FIG. 4QQQ

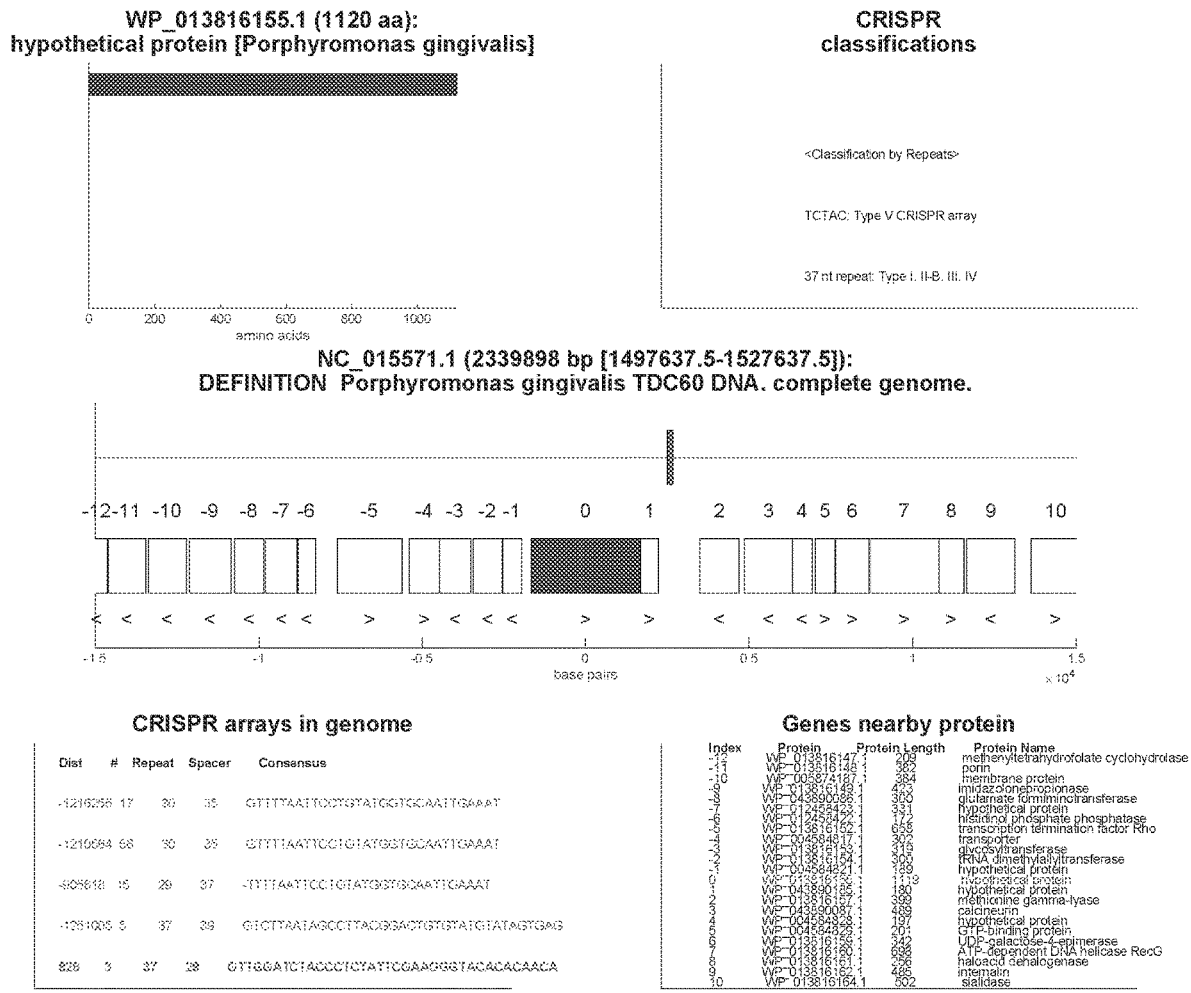
FIG. 4RRR

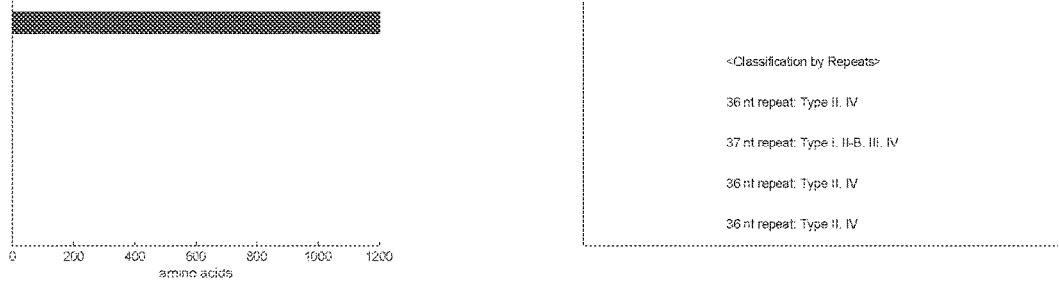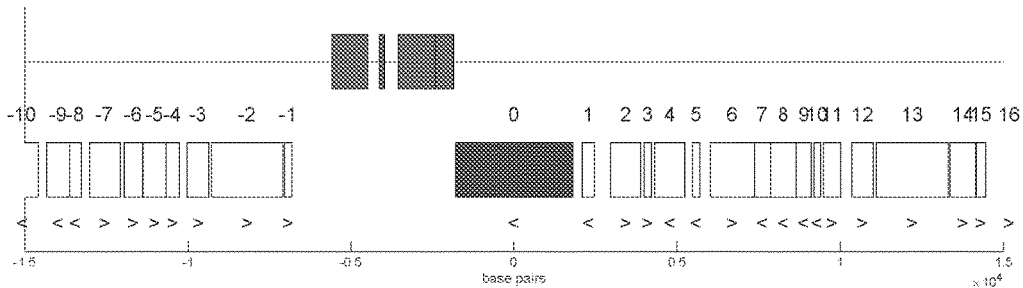
FIG. 4SSS

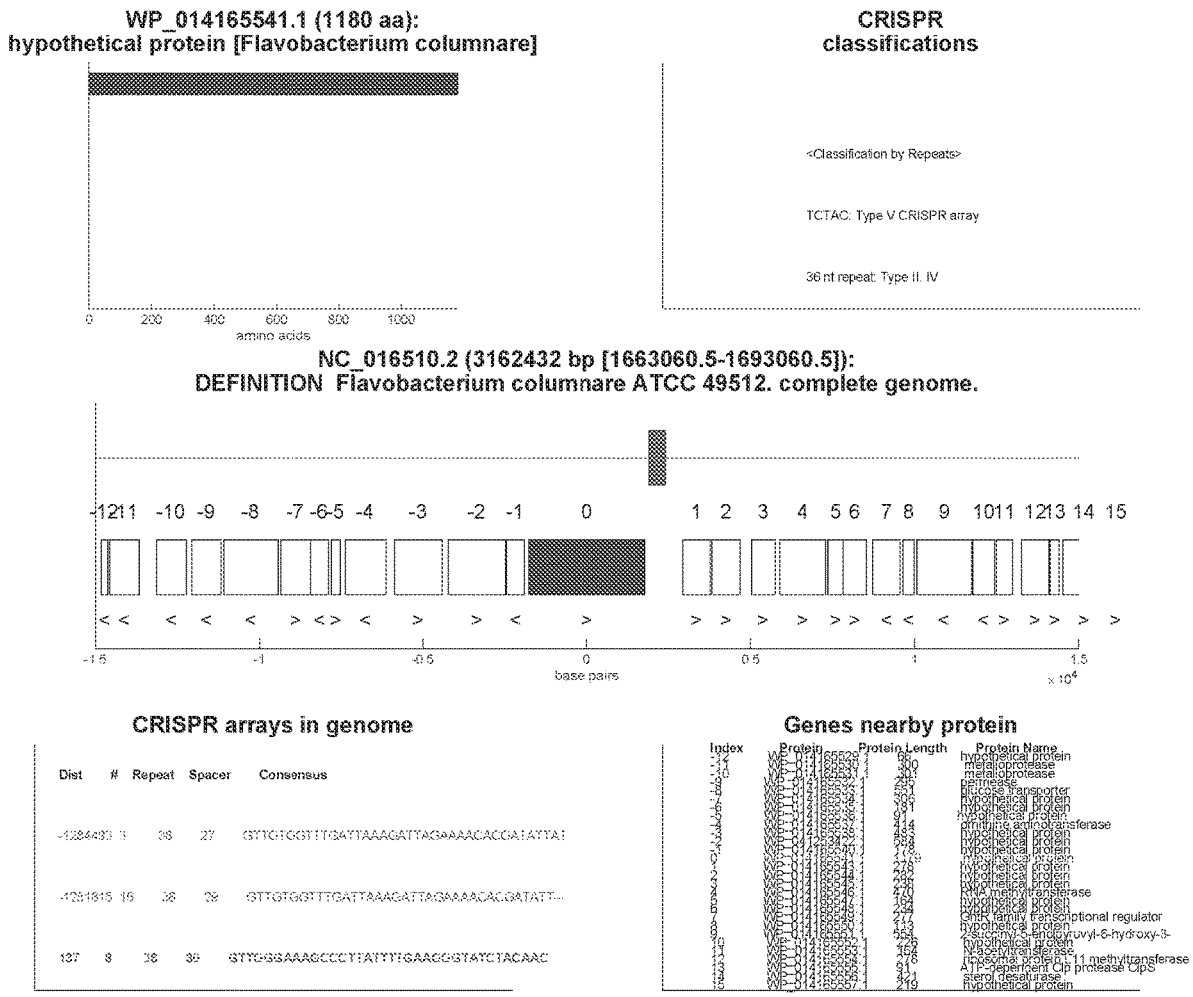
FIG. 4TTT

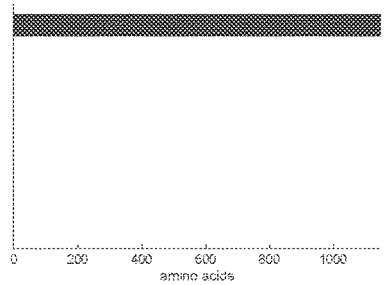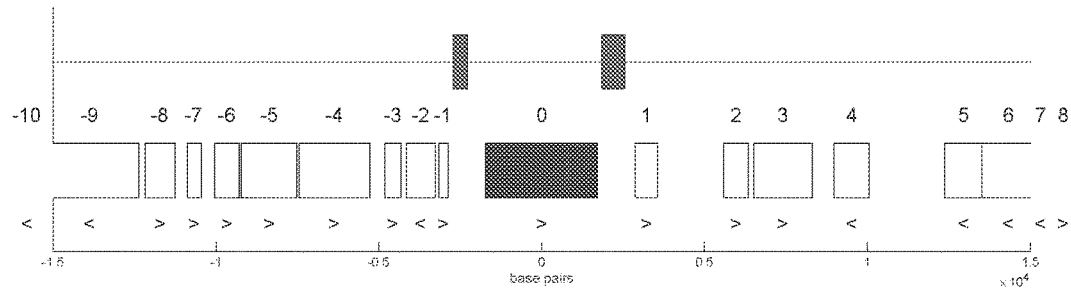
FIG. 4UUU

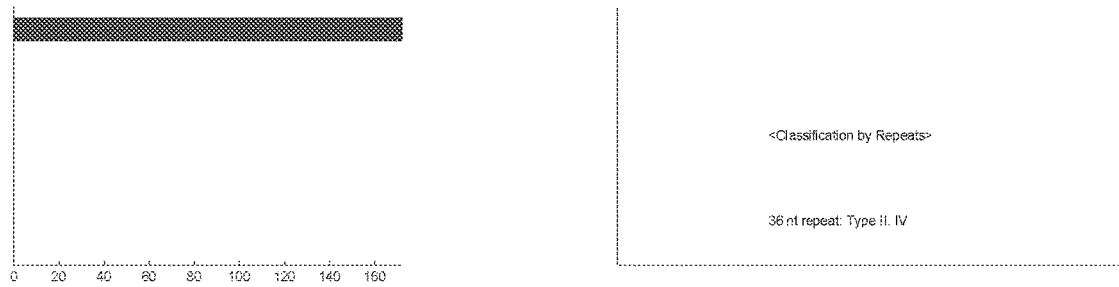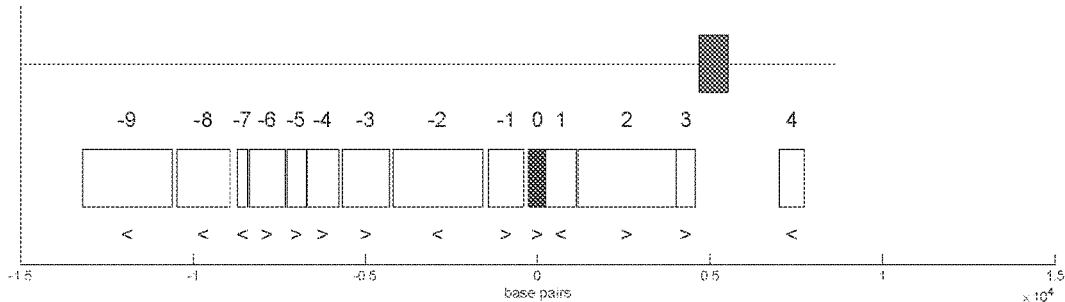
FIG. 4VVV

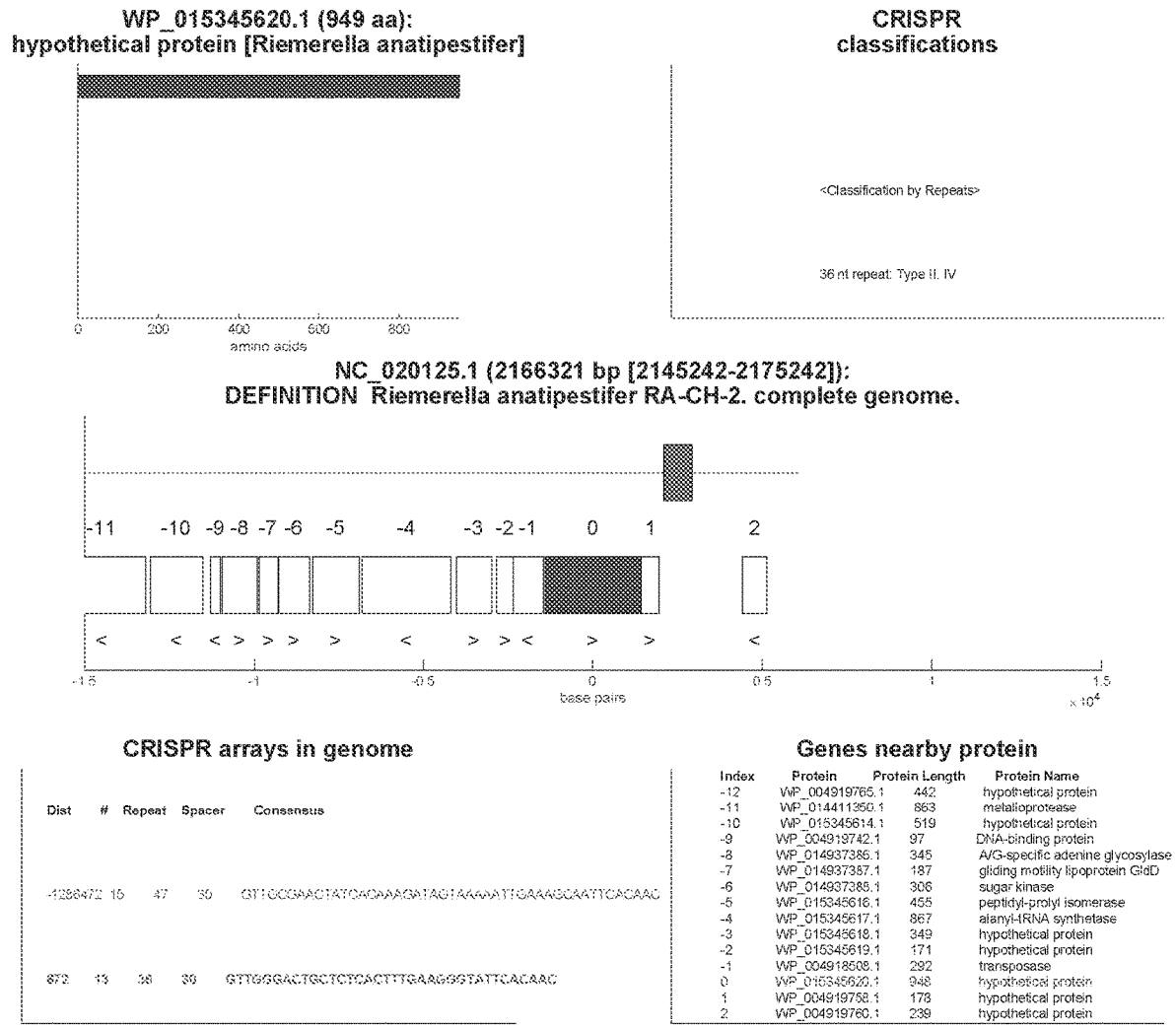
FIG. 4WWWW

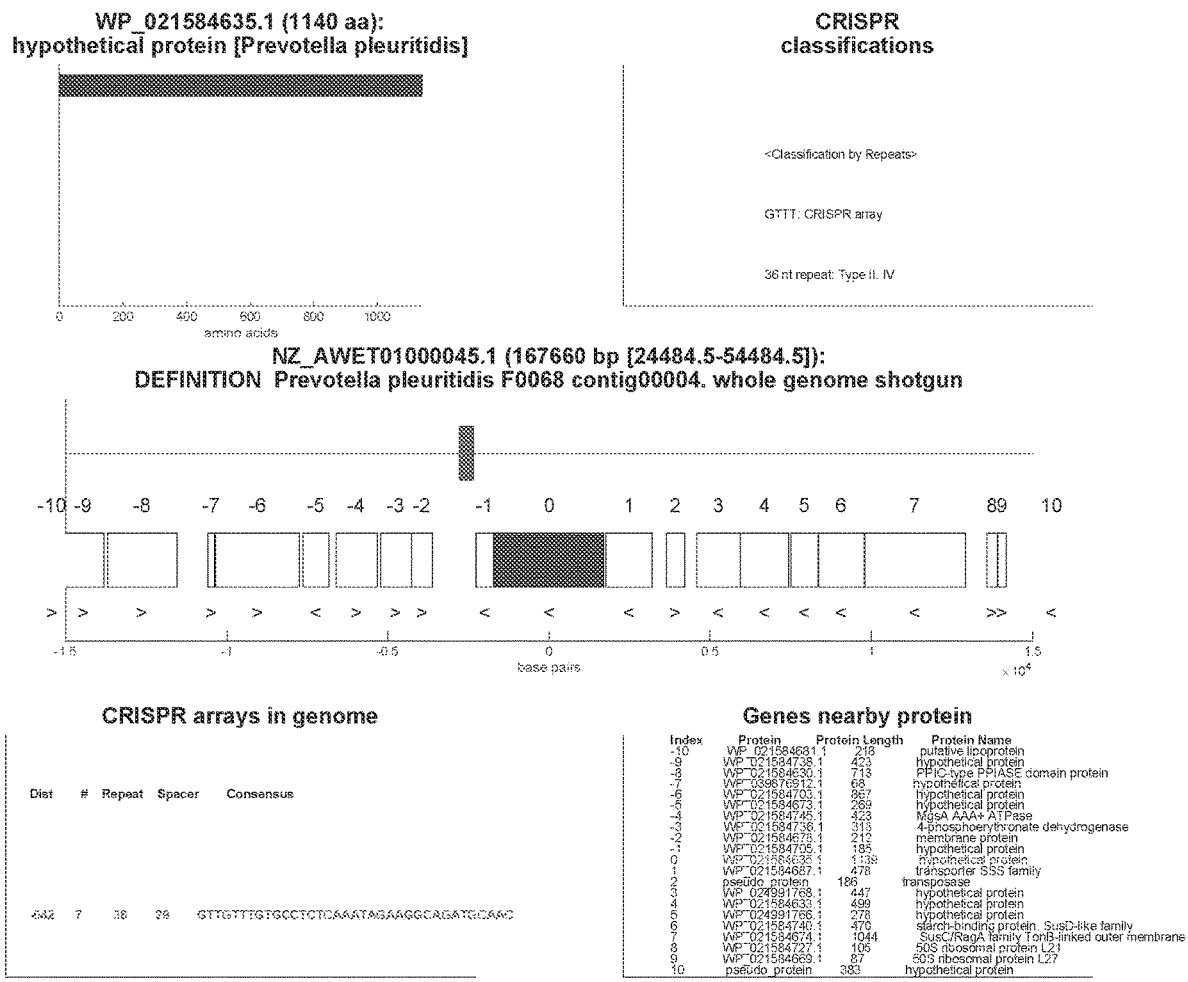
FIG. 4XXX

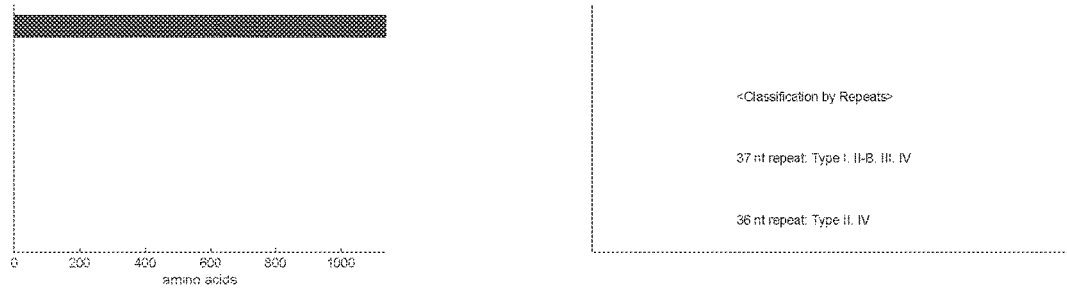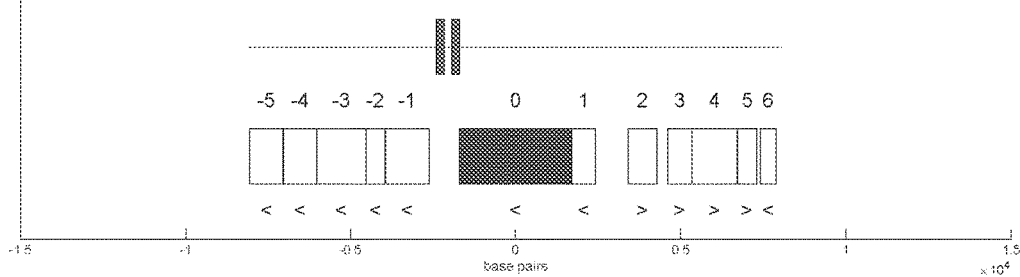
FIG. 4YYY

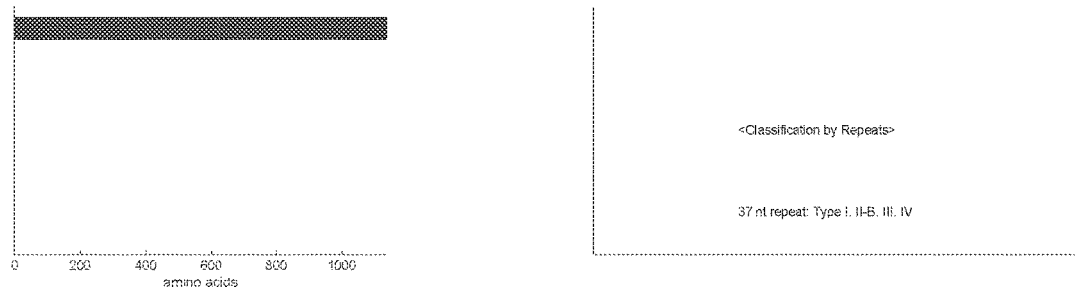
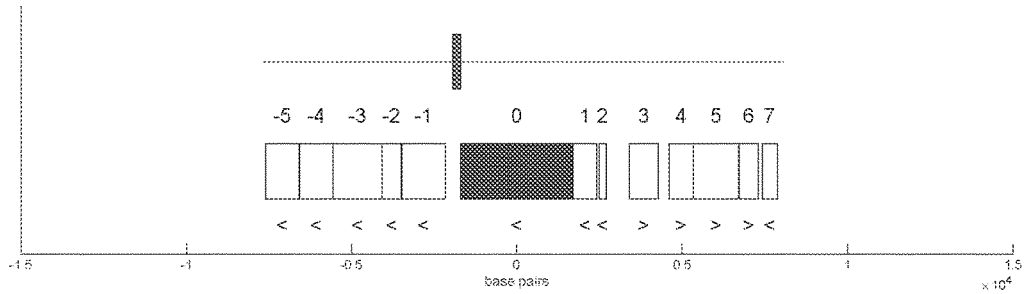
FIG. 4ZZZ

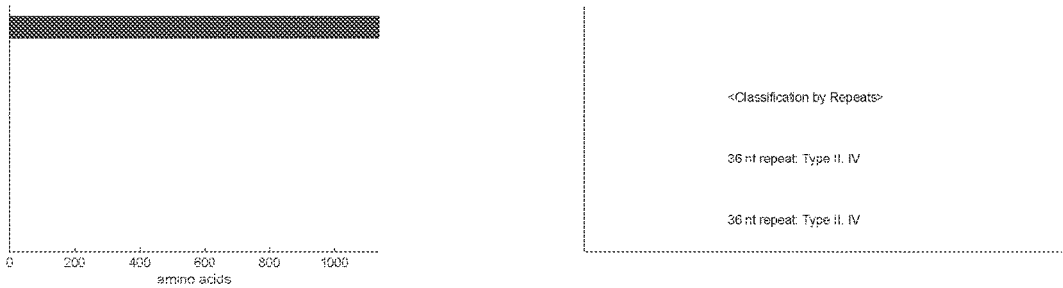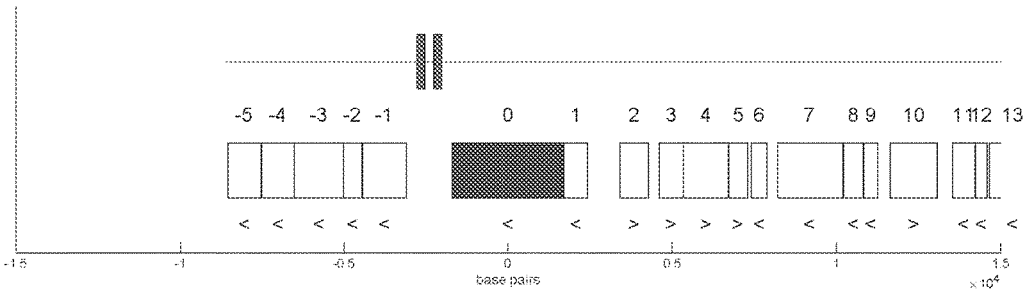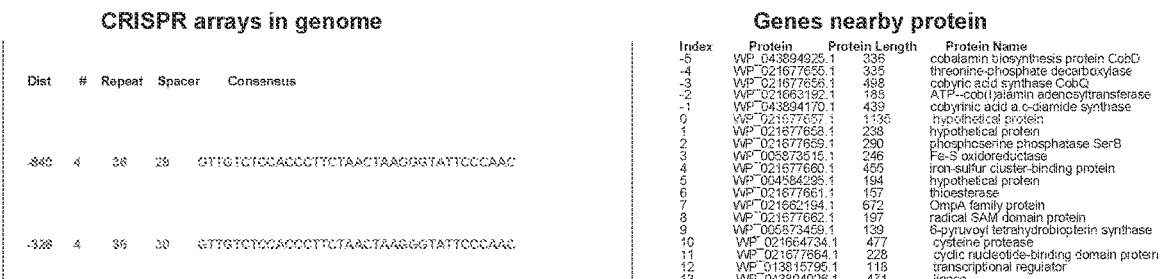
FIG. 4AAAA

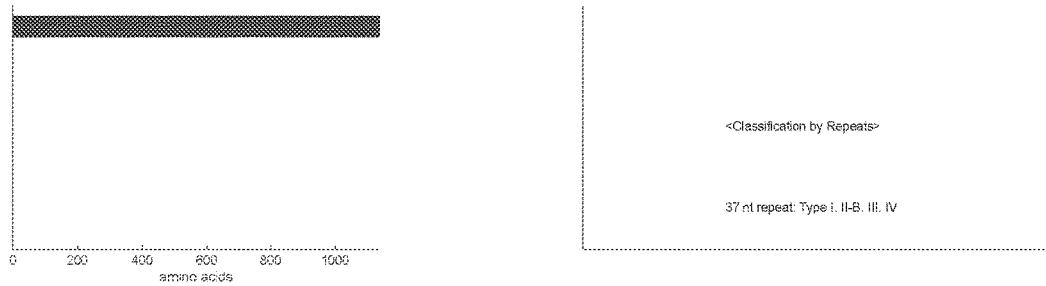
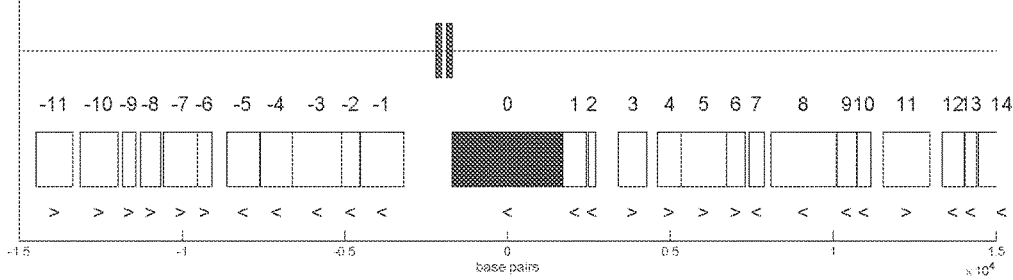
FIG. 4BBBB

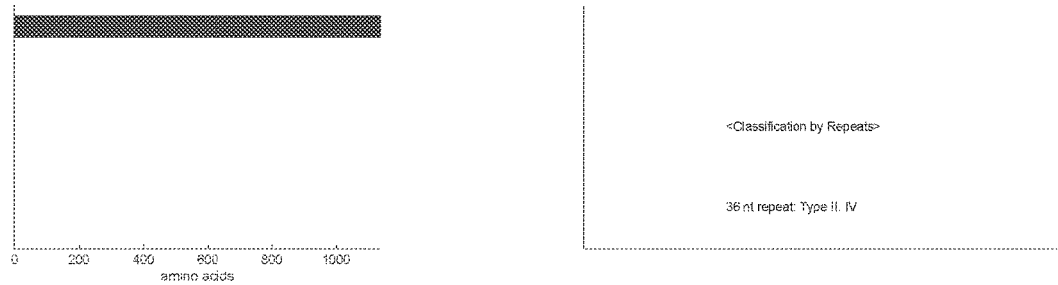
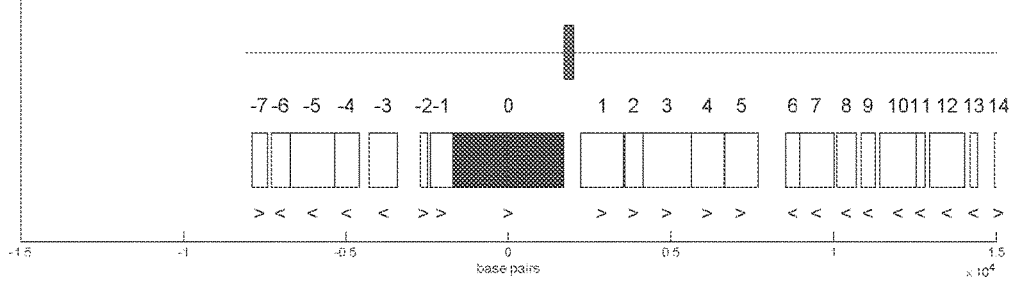
FIG. 4CCCC

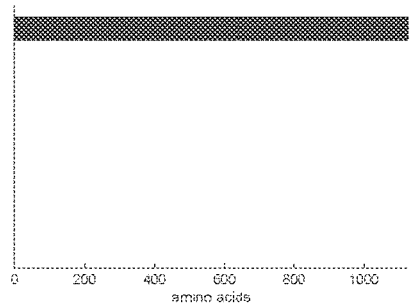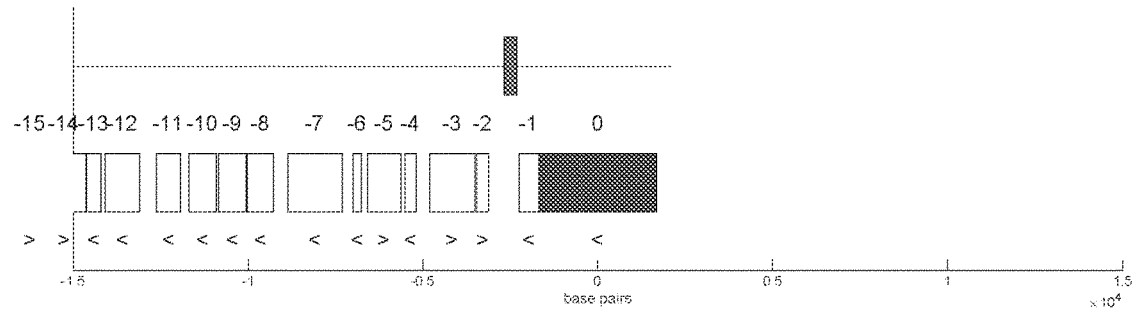
FIG. 4DDDD

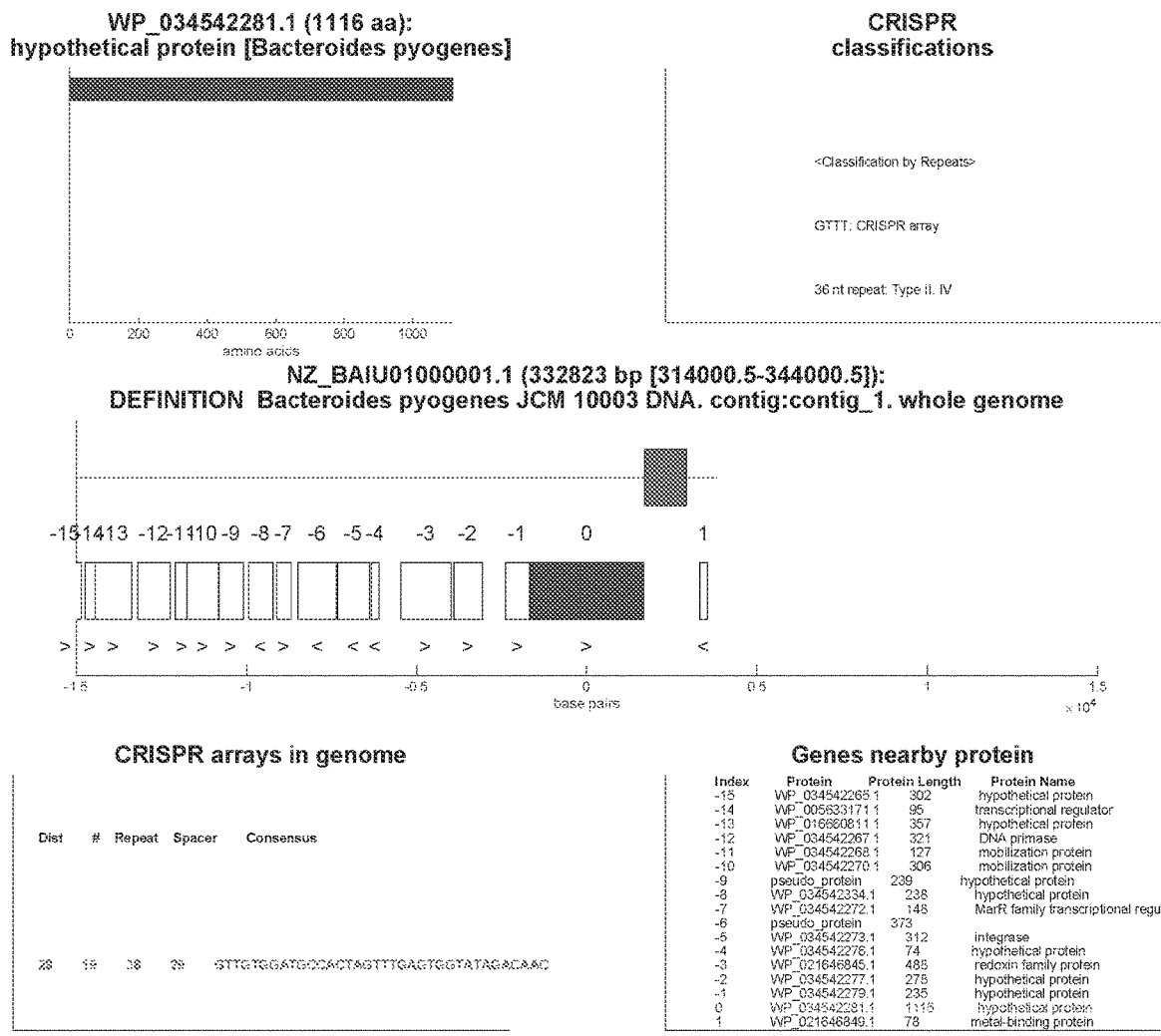
FIG. 4EEEE

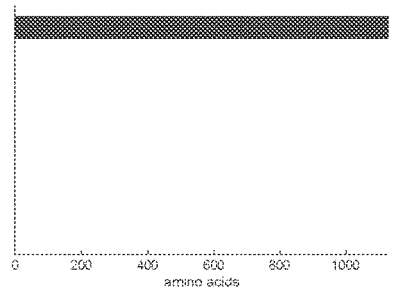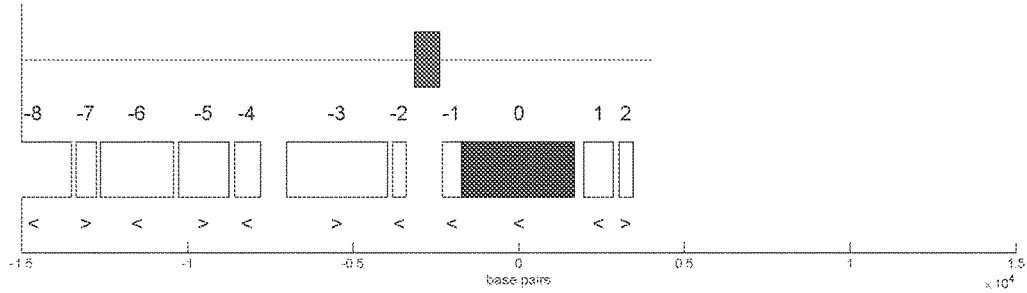
FIG. 4FFFF

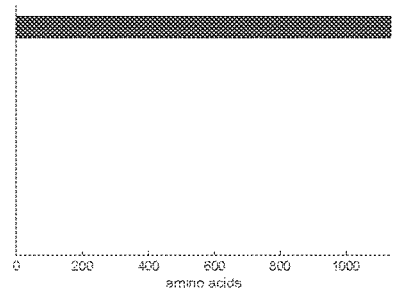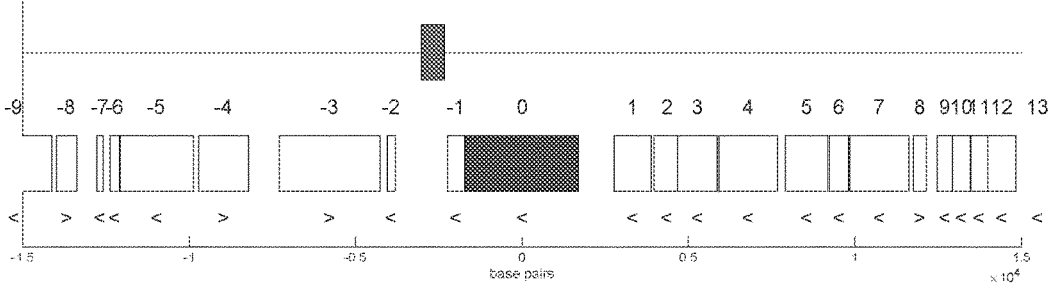
FIG. 4GGGG

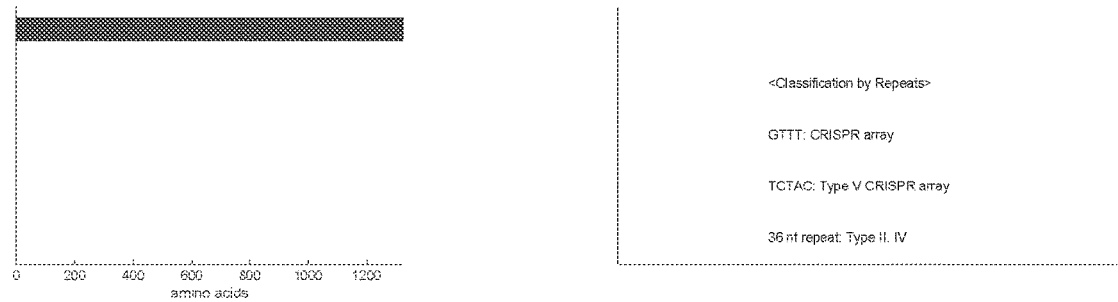
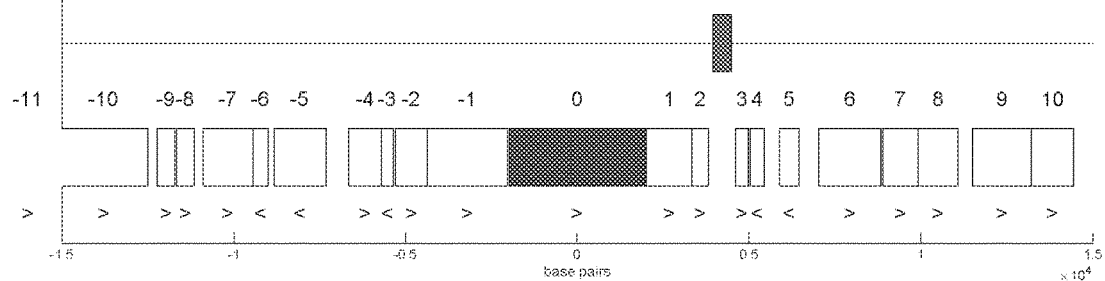
FIG. 4HHHH

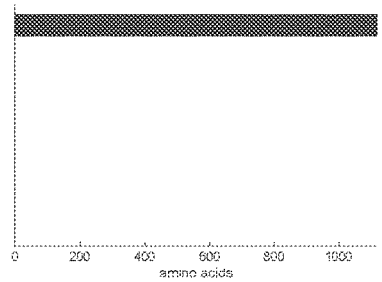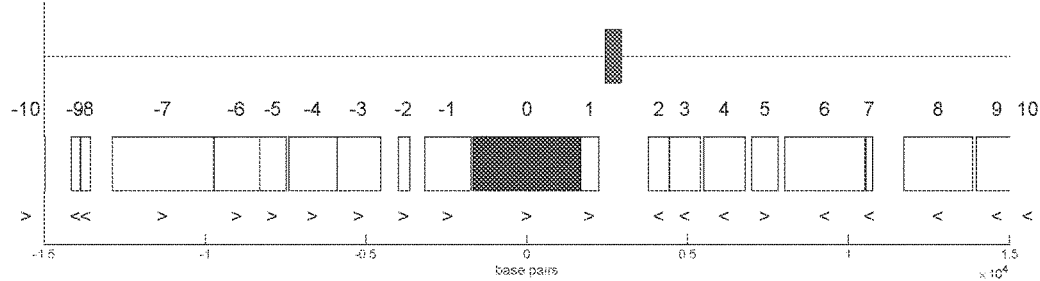
FIG. 4IIII

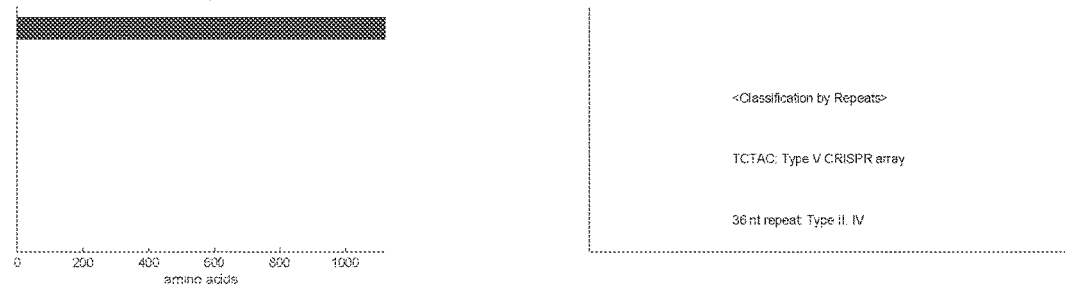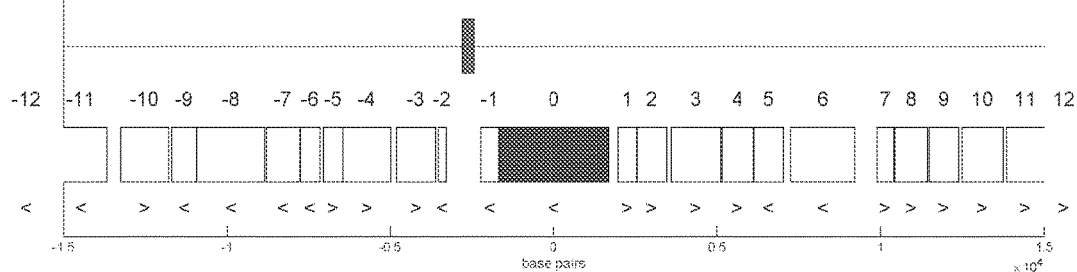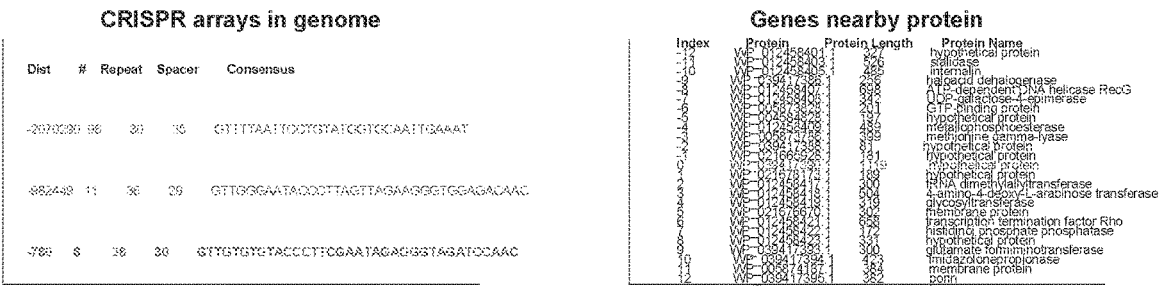
FIG. 4JJJJ

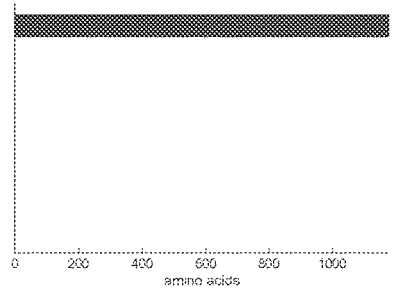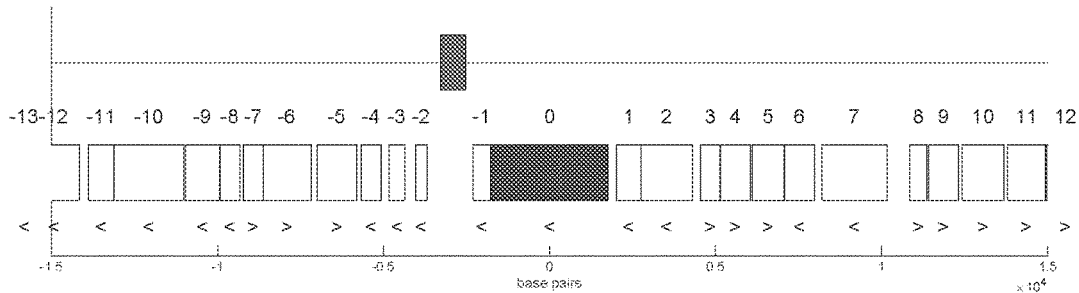
FIG. 4KKKK

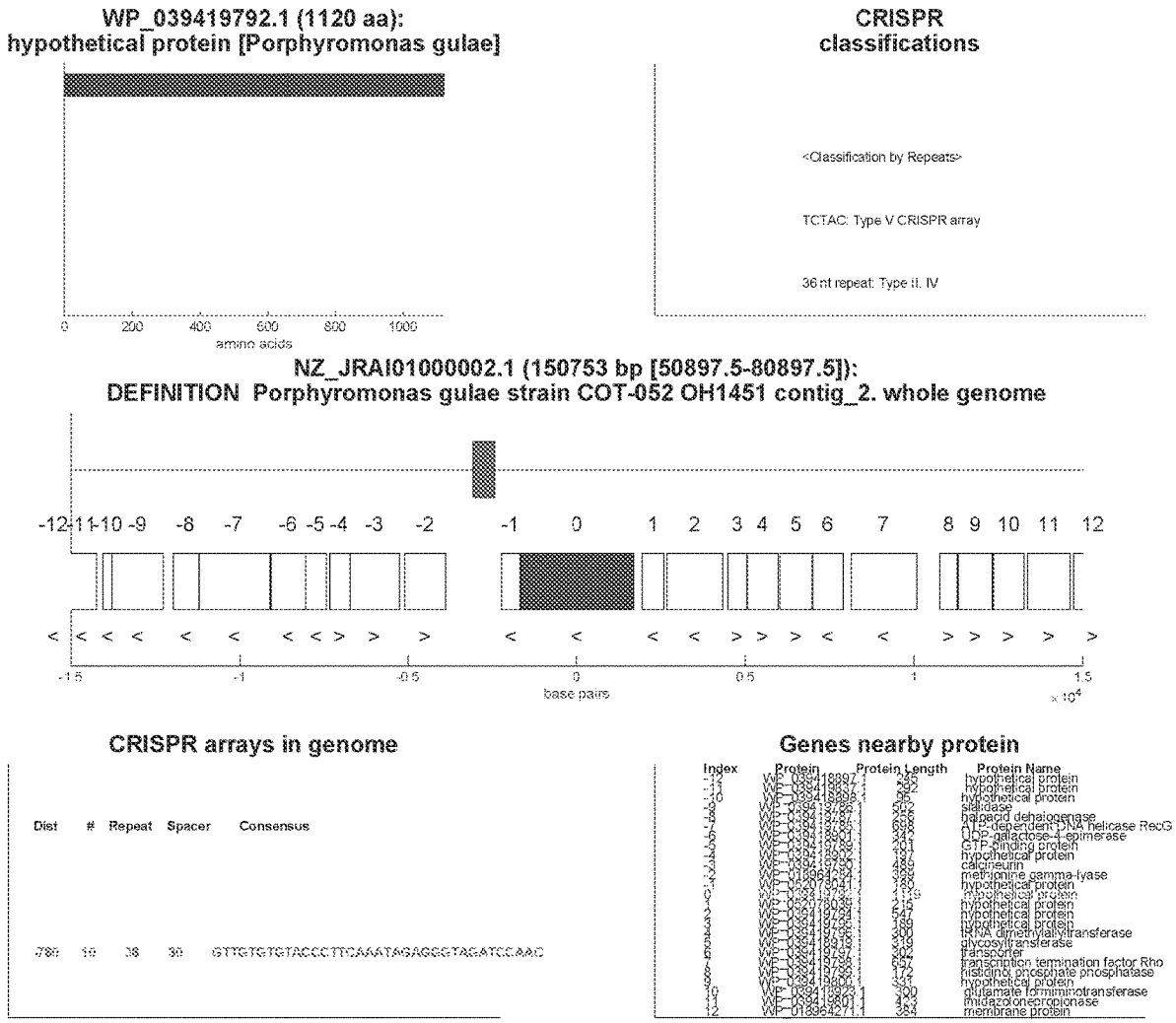
FIG. 4LLLL

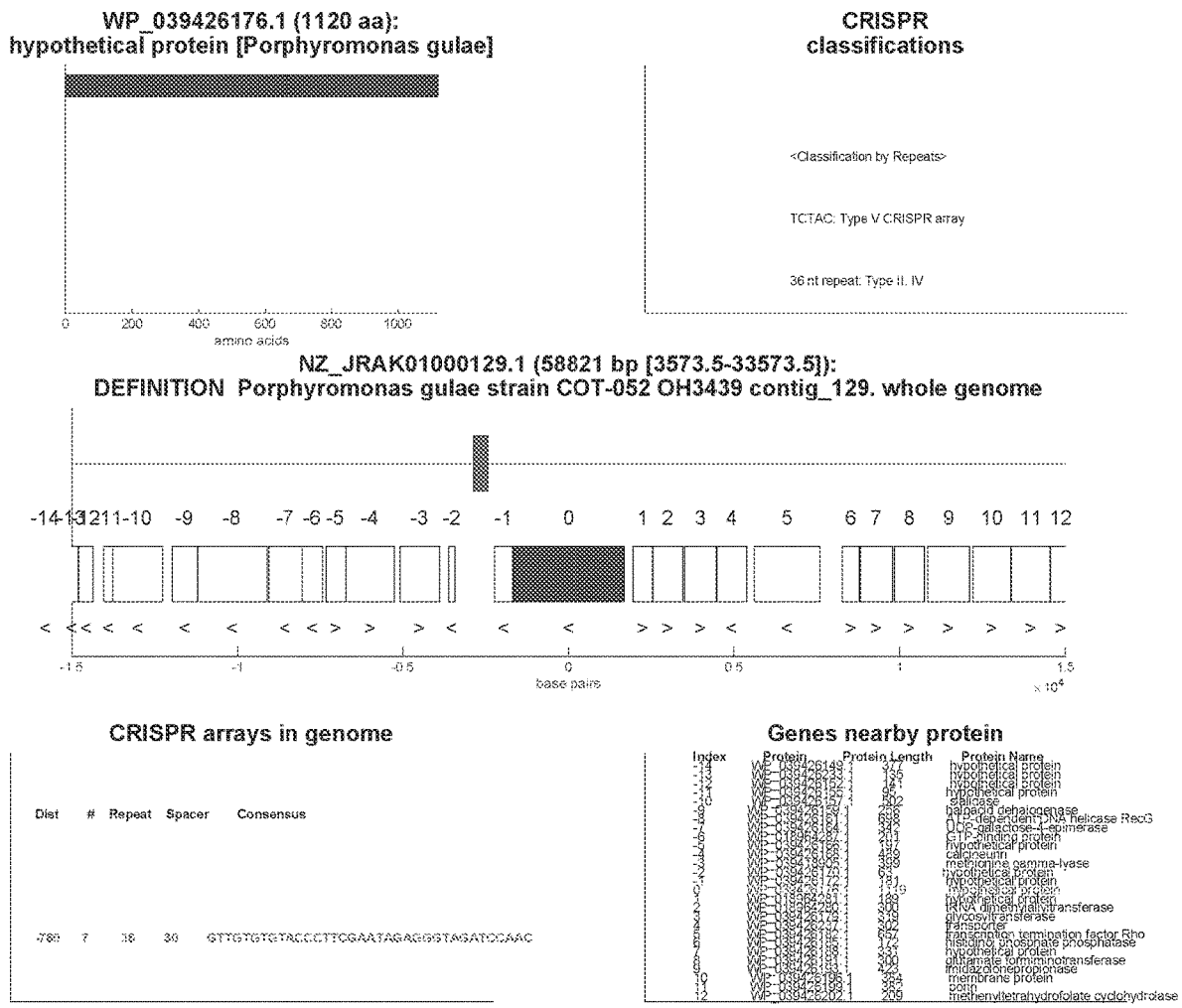
FIG. 4MMMM

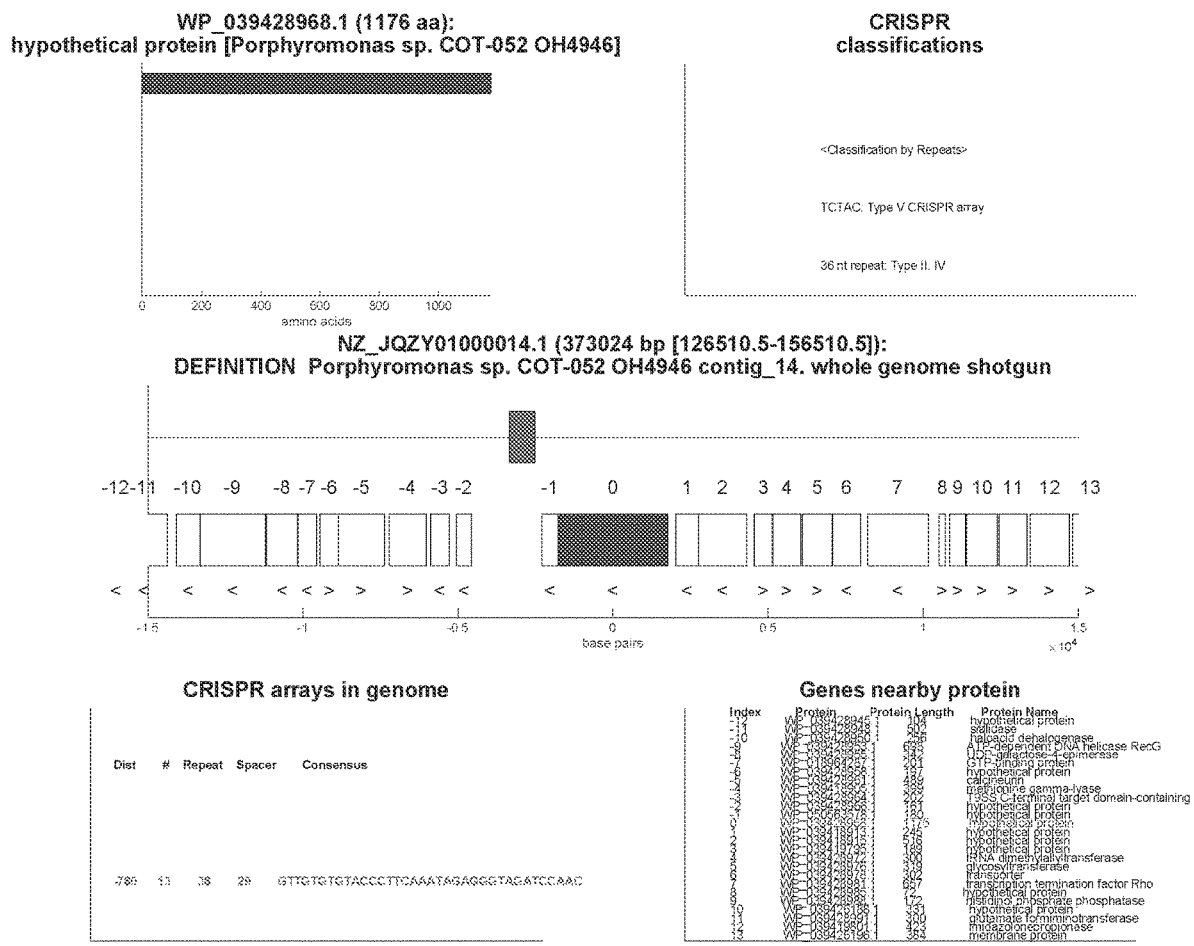
FIG. 4NNNN

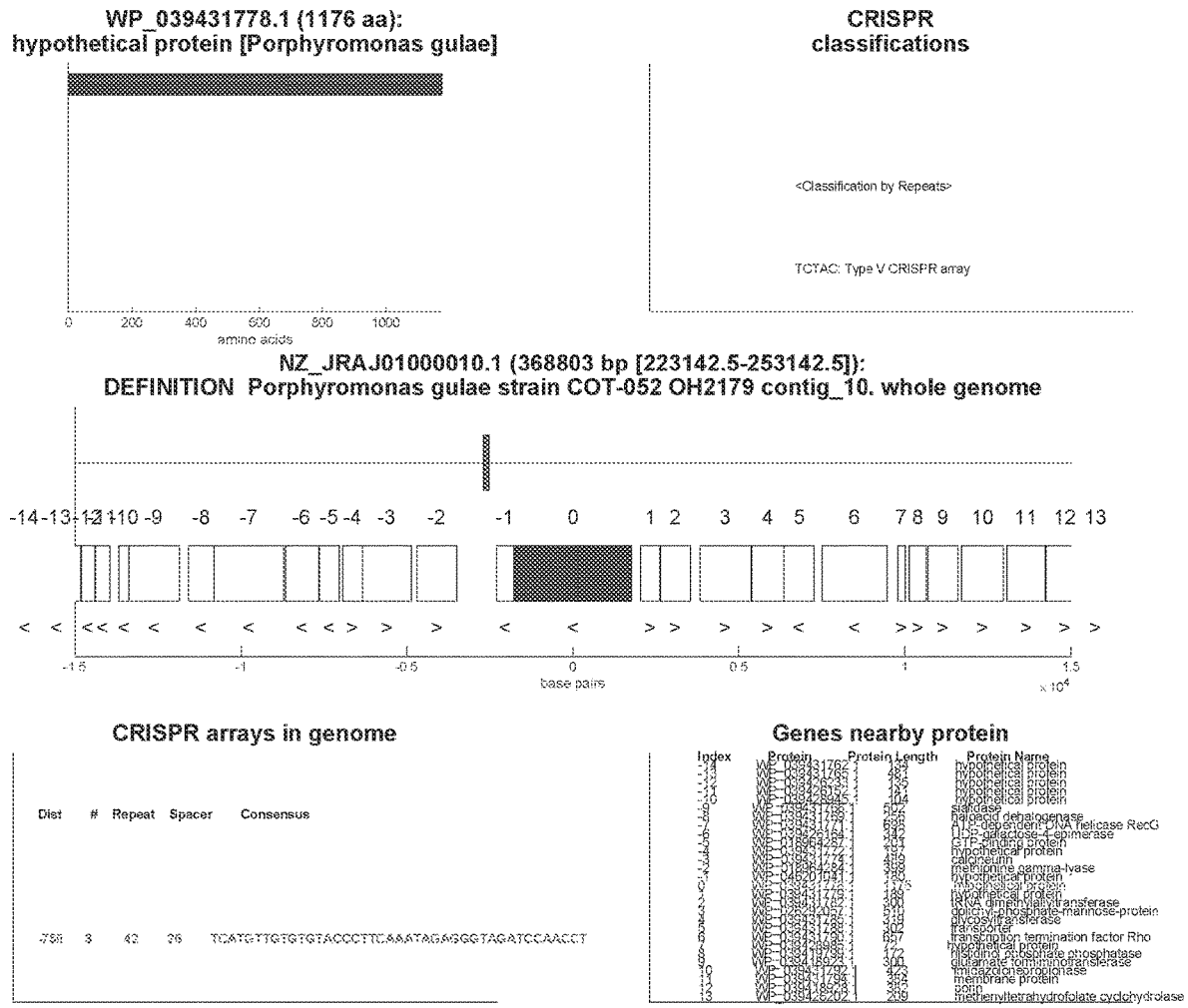
FIG. 40000

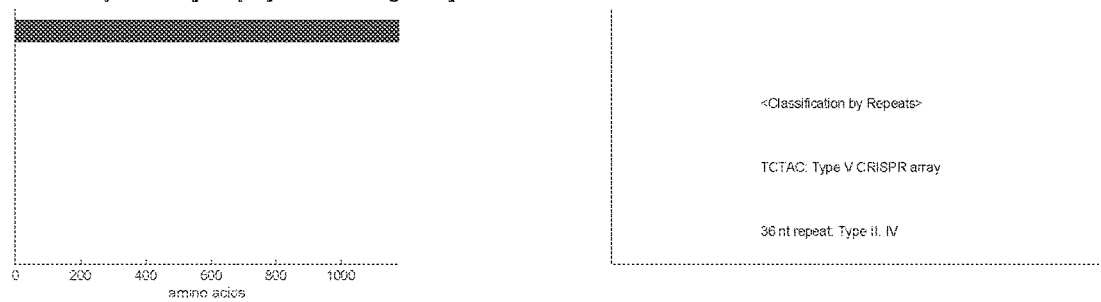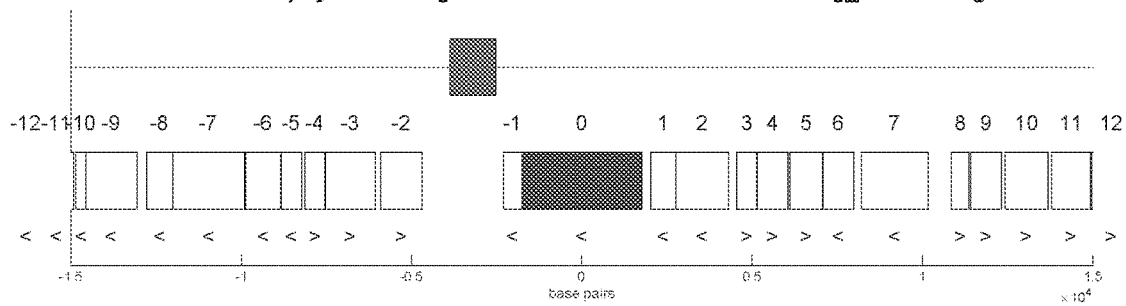
FIG. 4PPPP

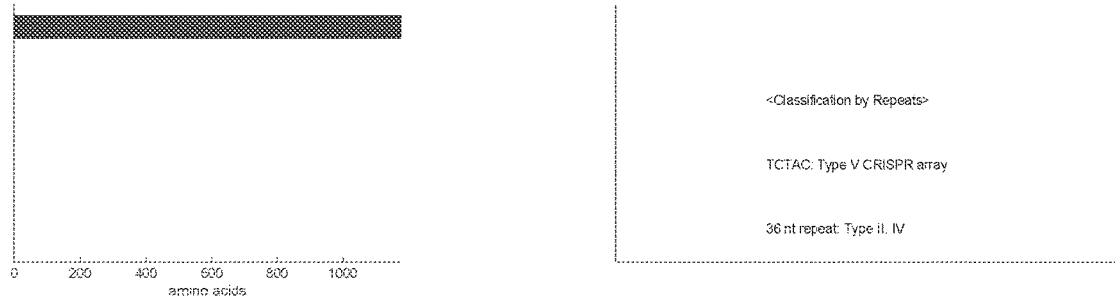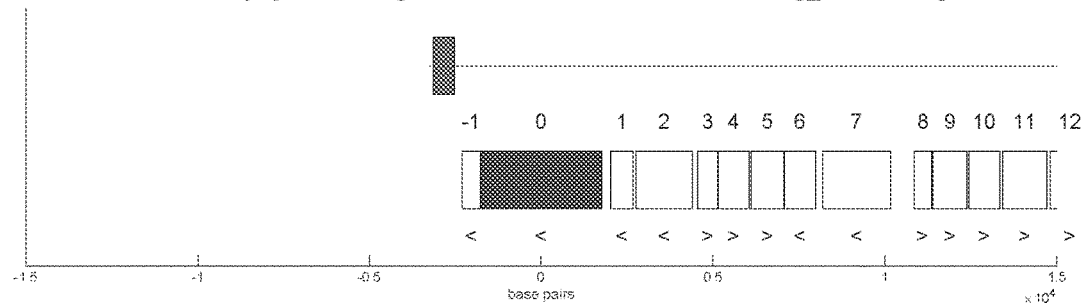
FIG. 4QQQQ

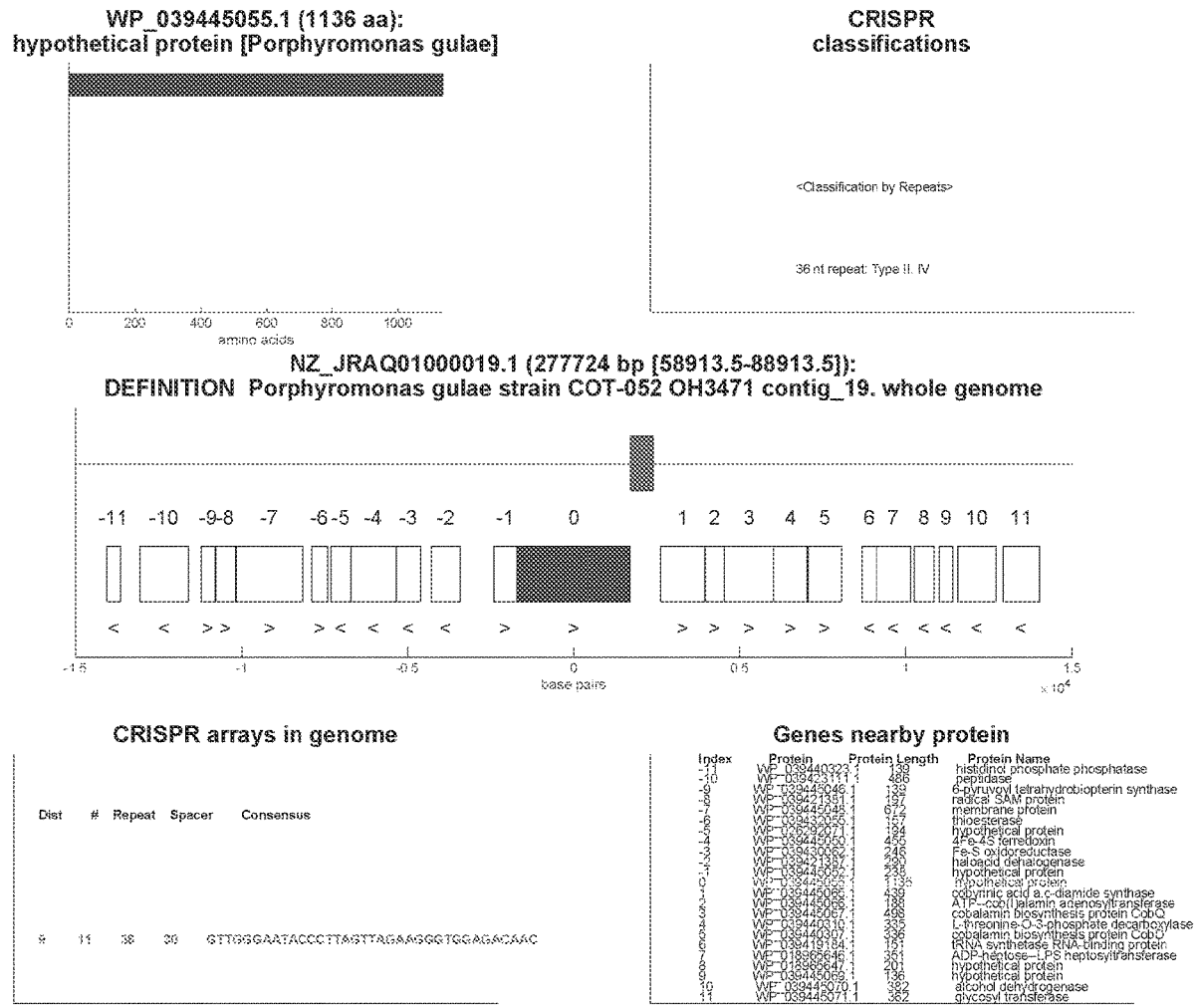
FIG. 4RRRR

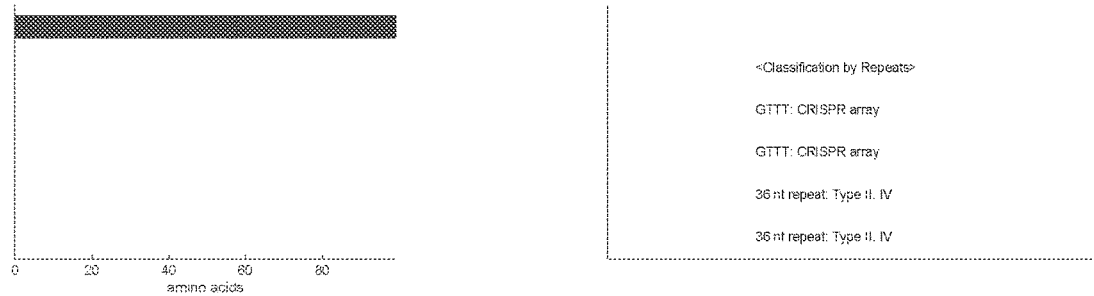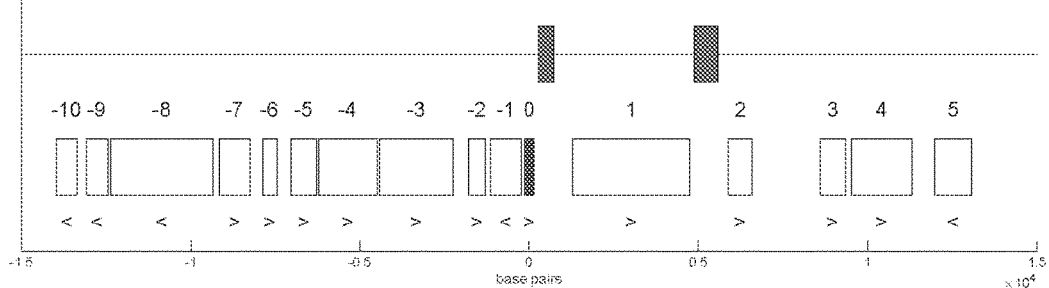
FIG. 4SSSS

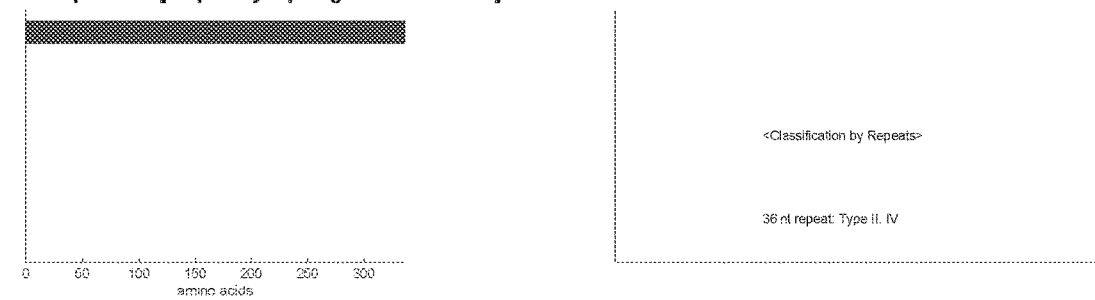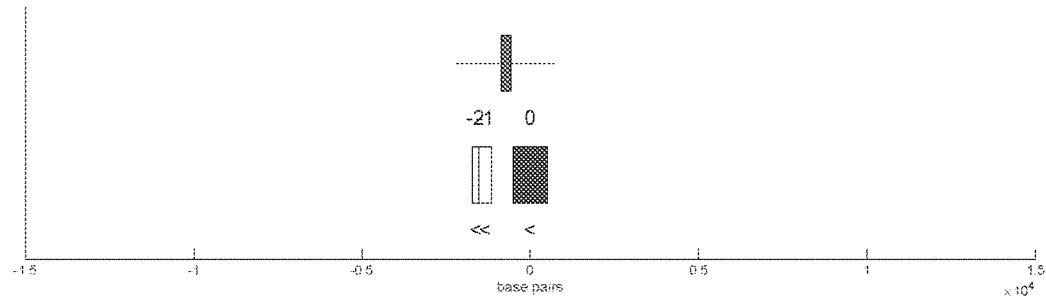
FIG. 4TTTT

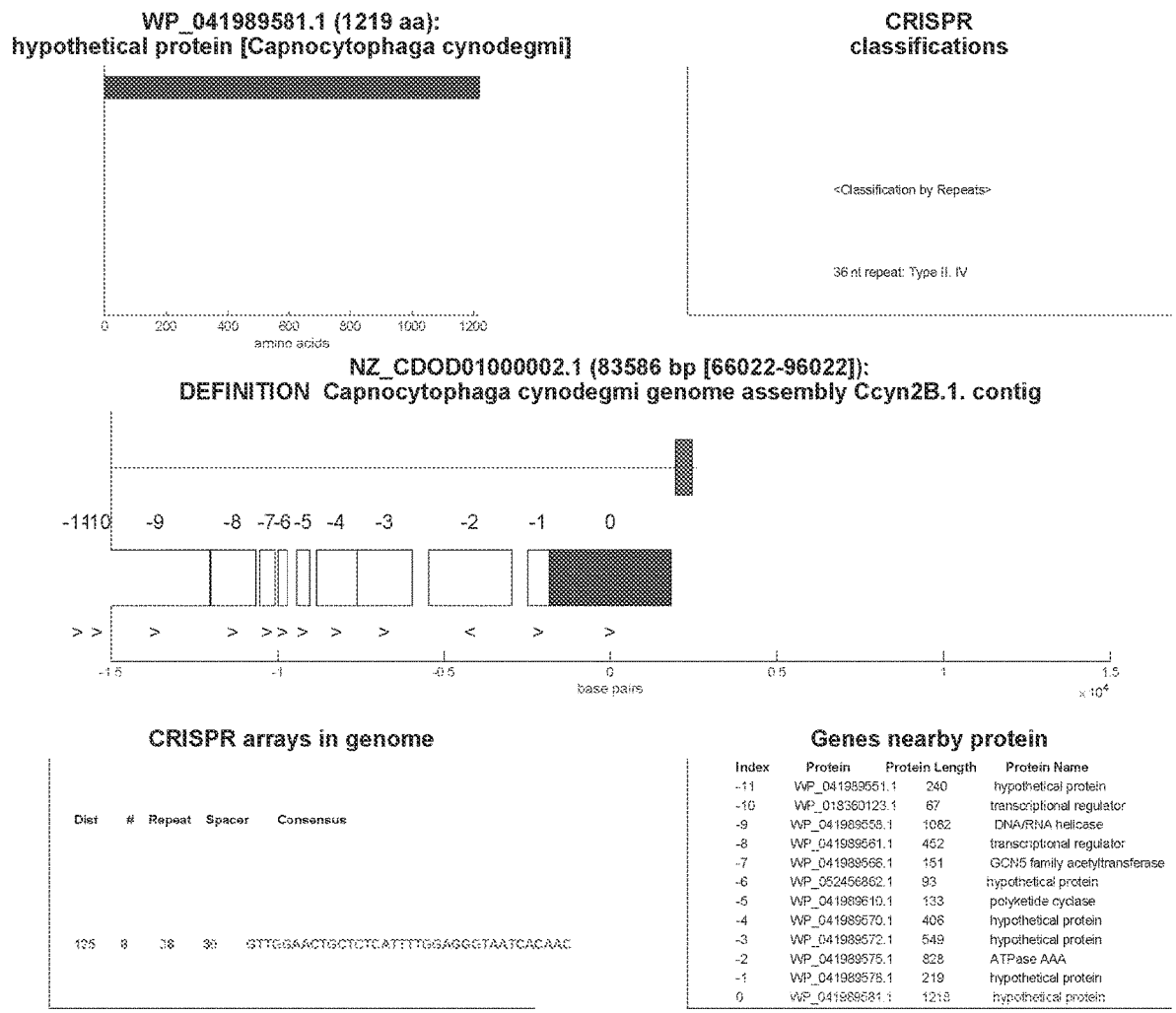
FIG. 4UUUU

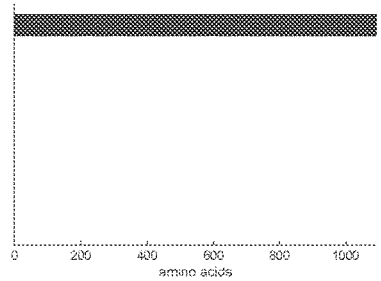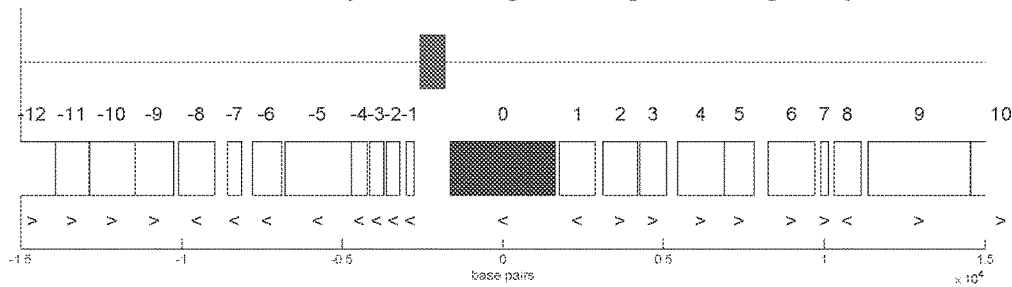
FIG. 4VVVV

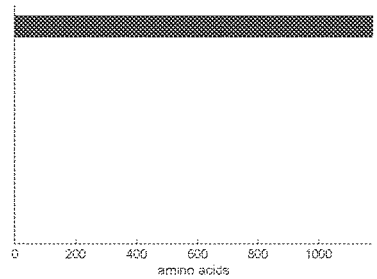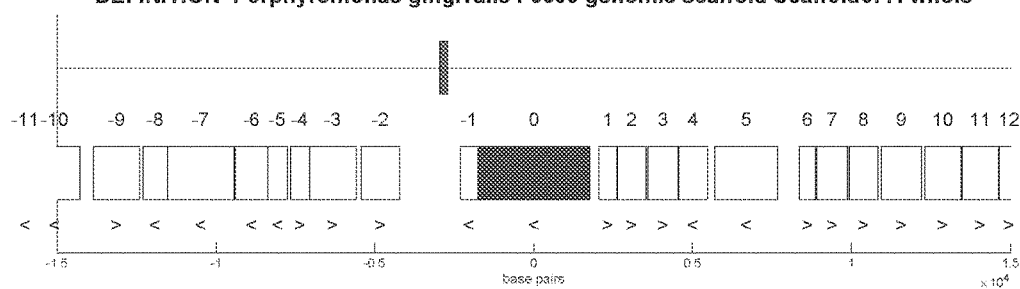
FIG. 4WWWW

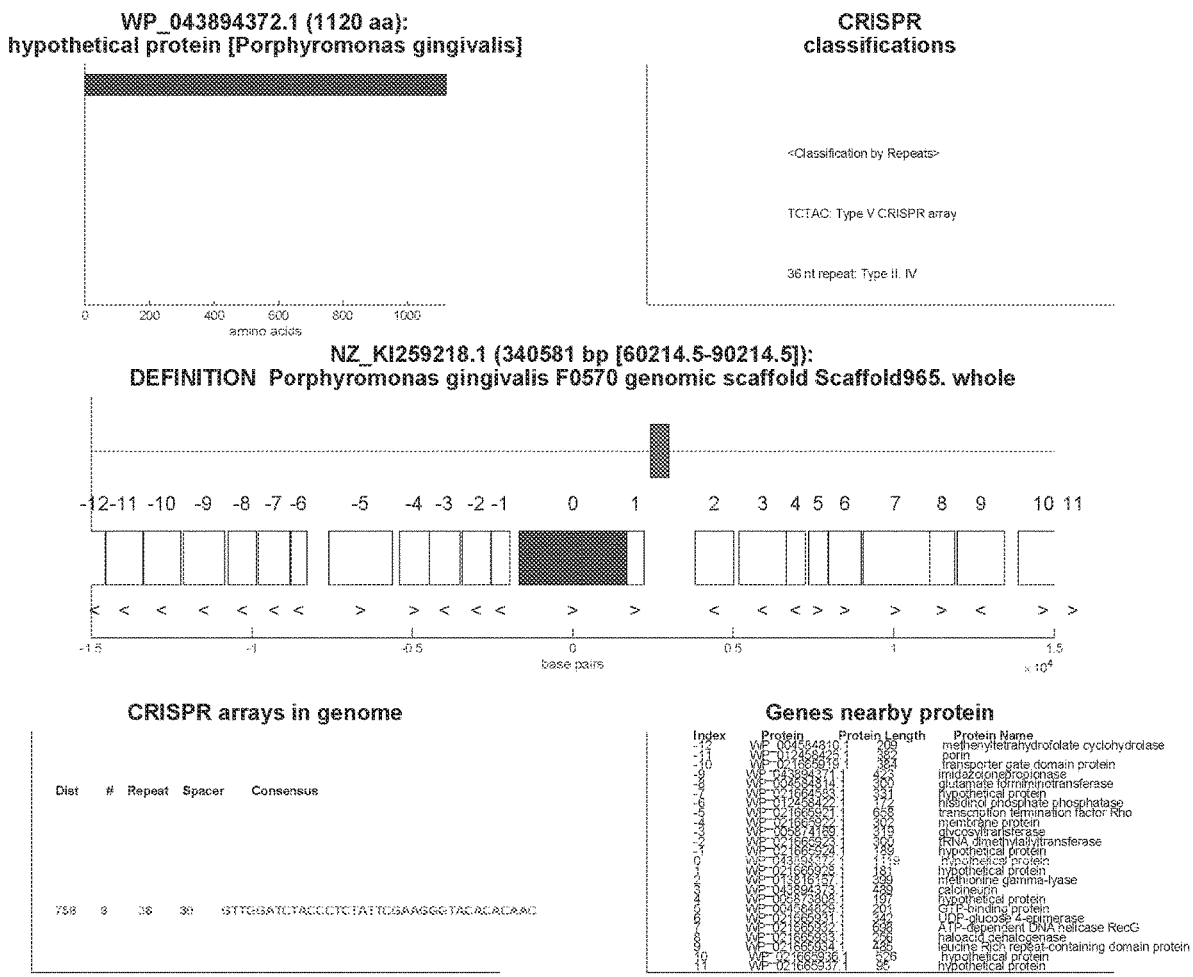
FIG. 4XXXX

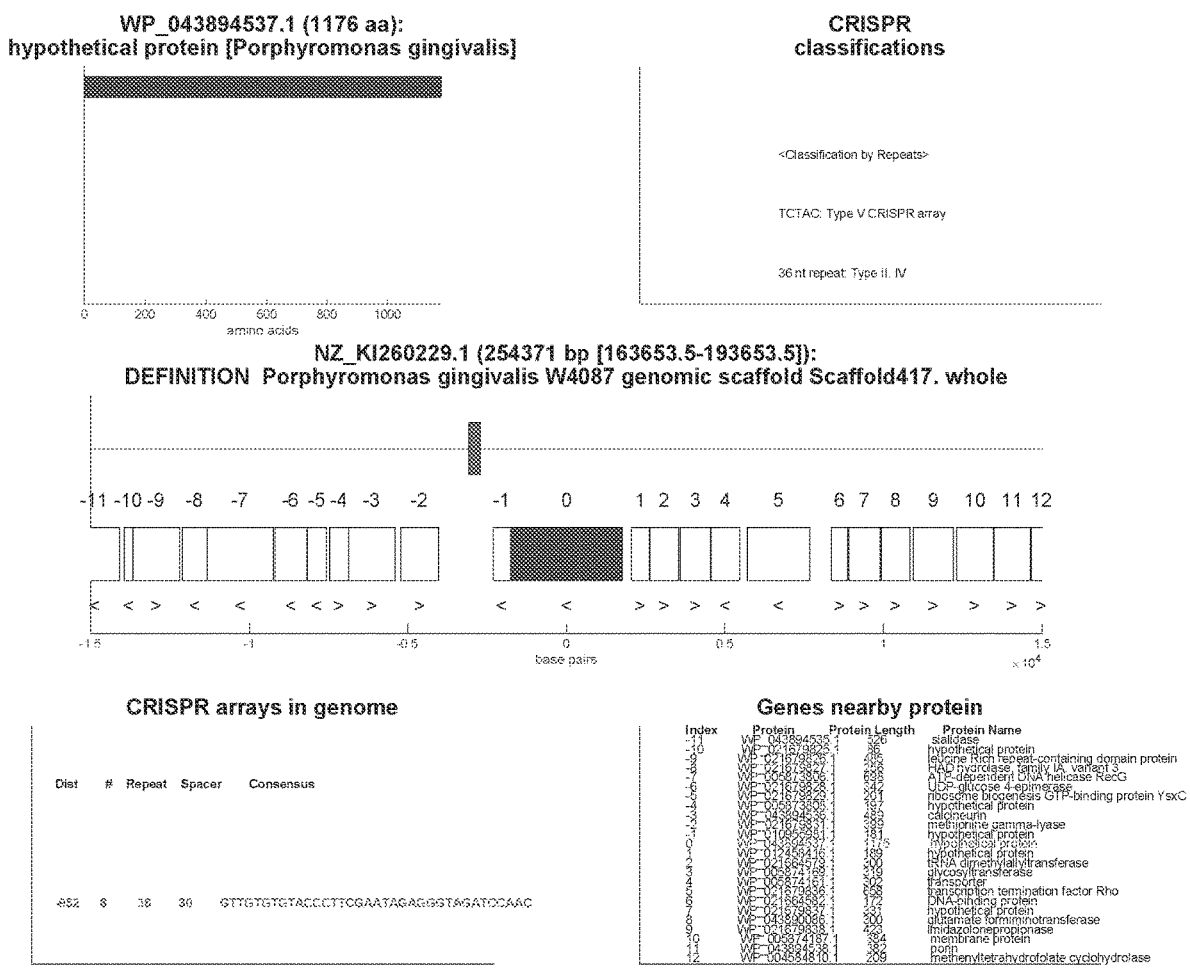
FIG. 4YYYY

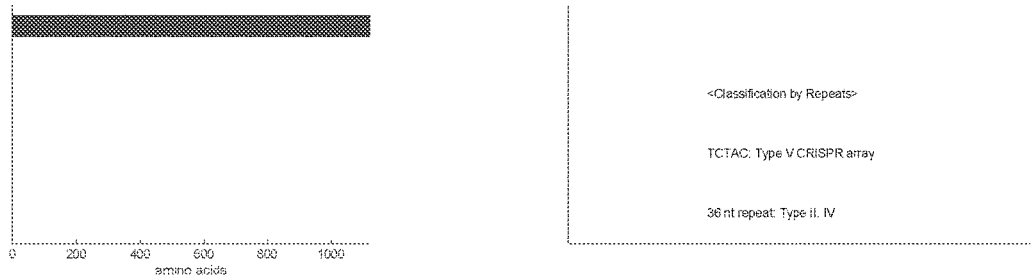
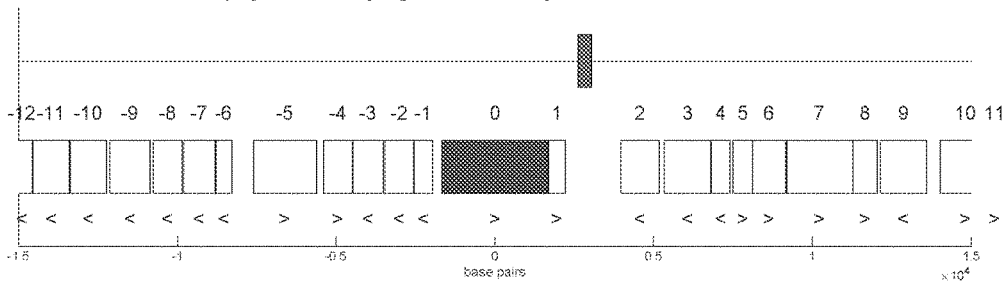
FIG. 4ZZZZ

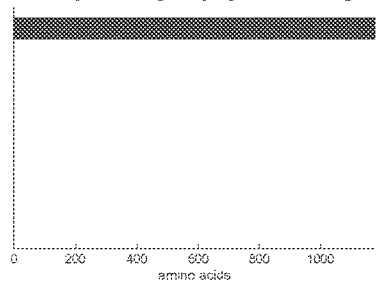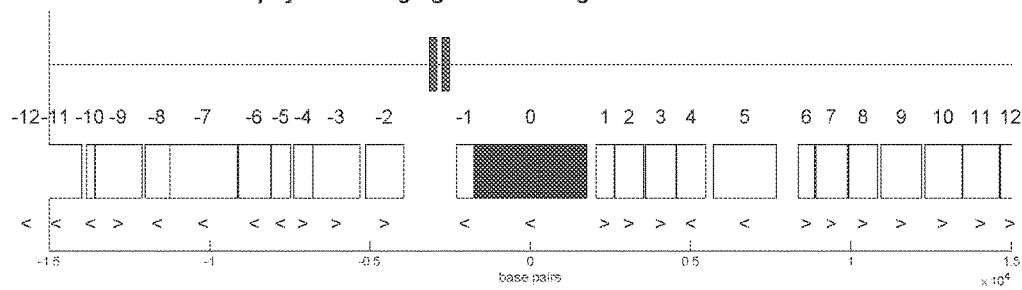
FIG. 4AAAAA

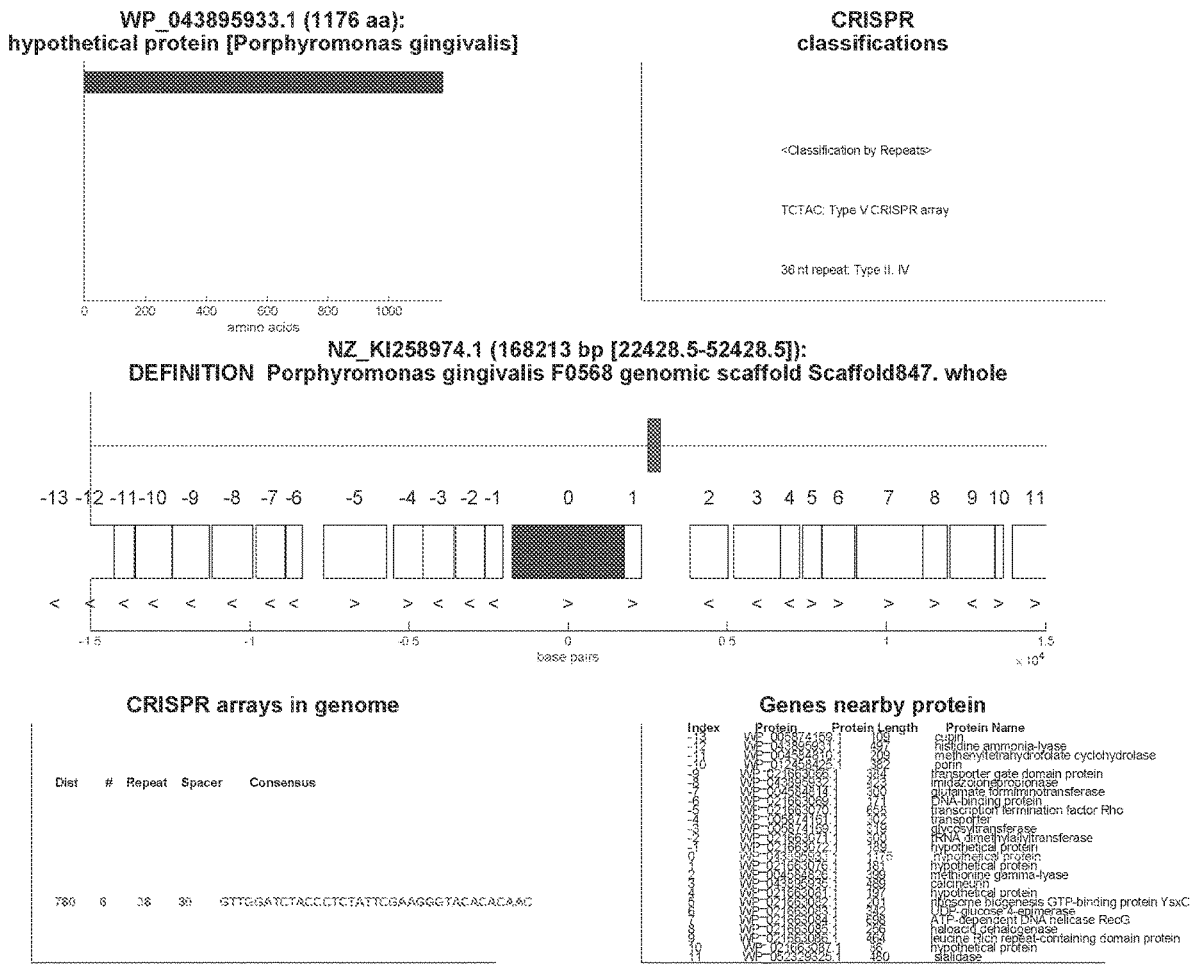
FIG. 4BBBBB

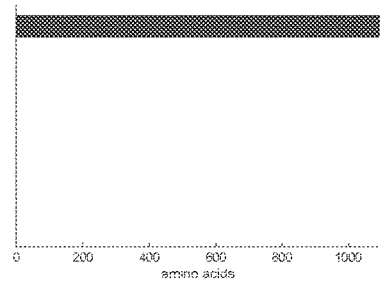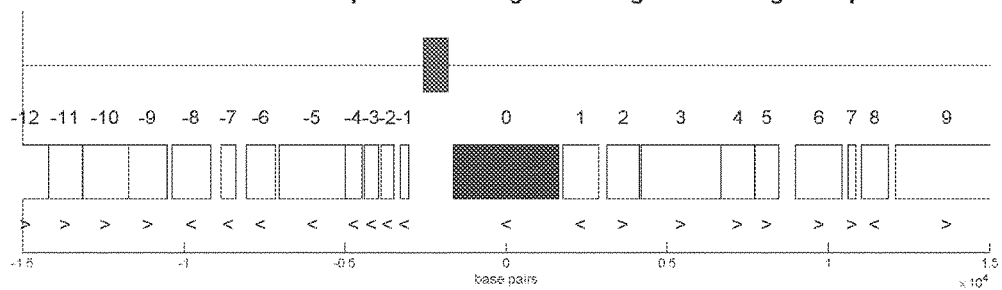
FIG. 4CCCCC

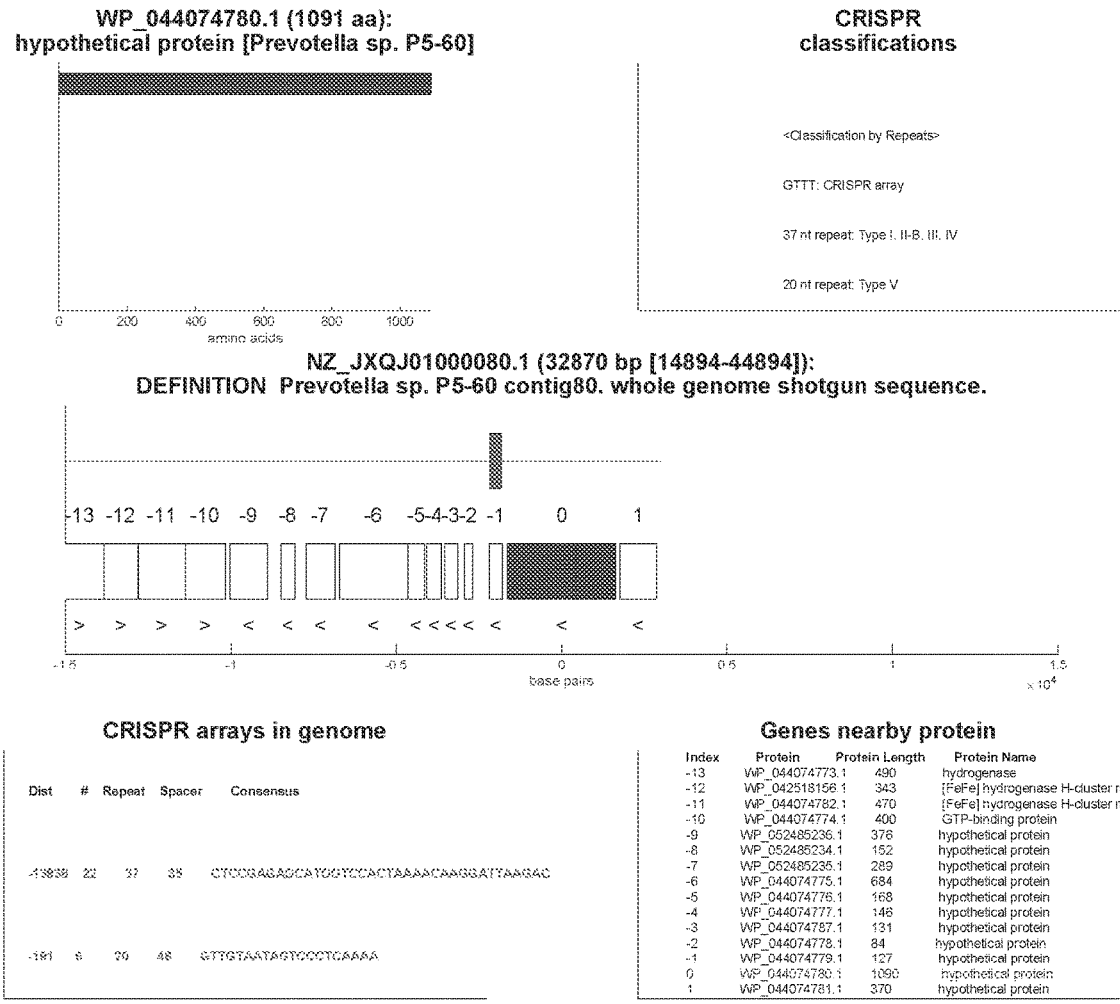
FIG. 4DDDDD

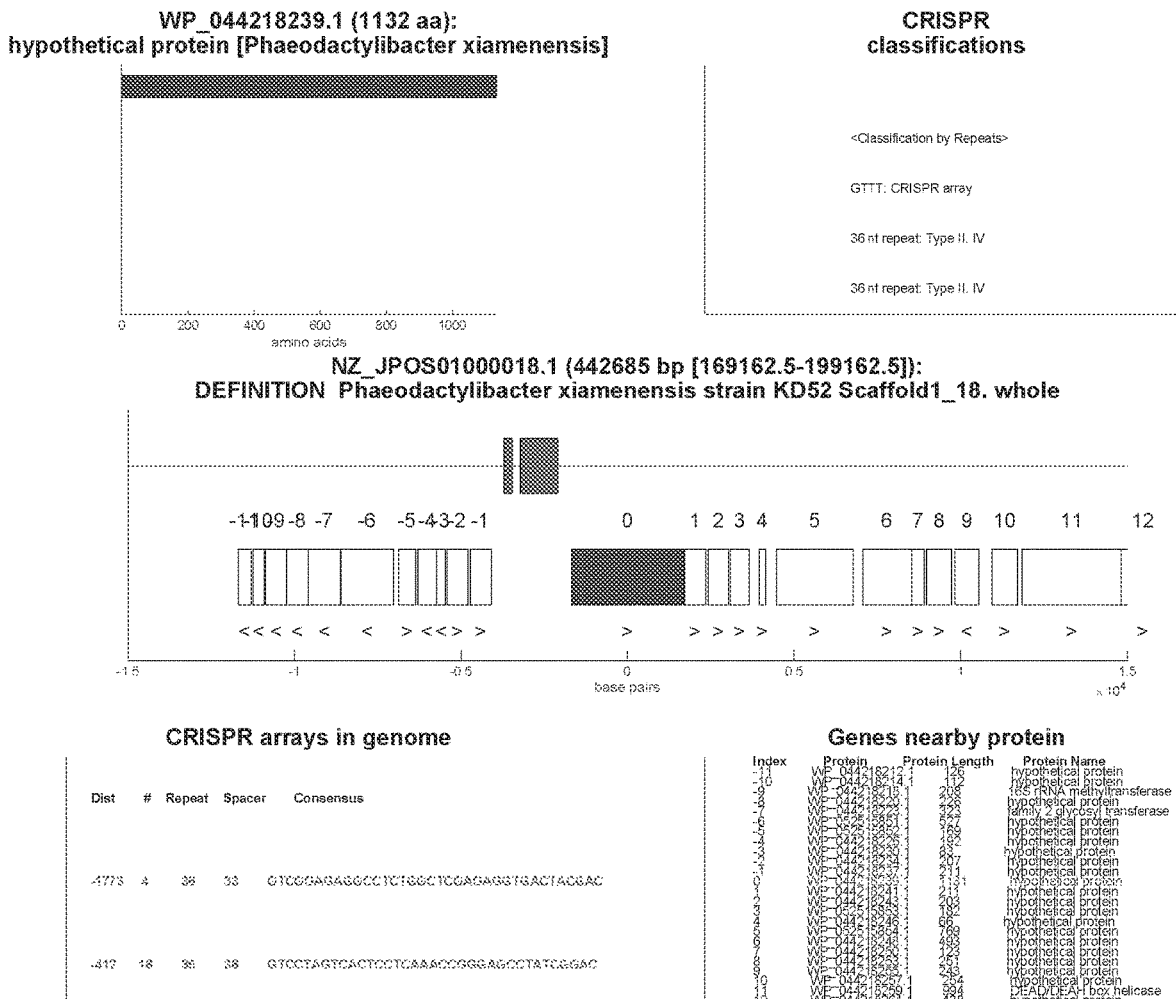
FIG. 4EEEEE

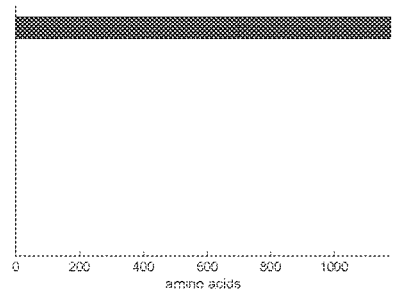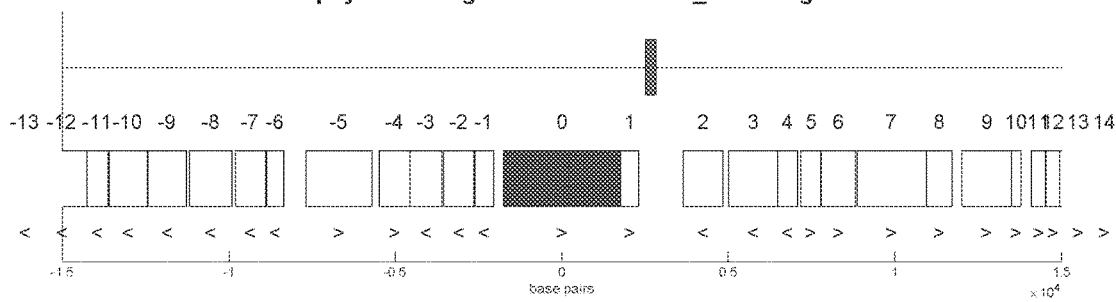
FIG. 4FFFFF

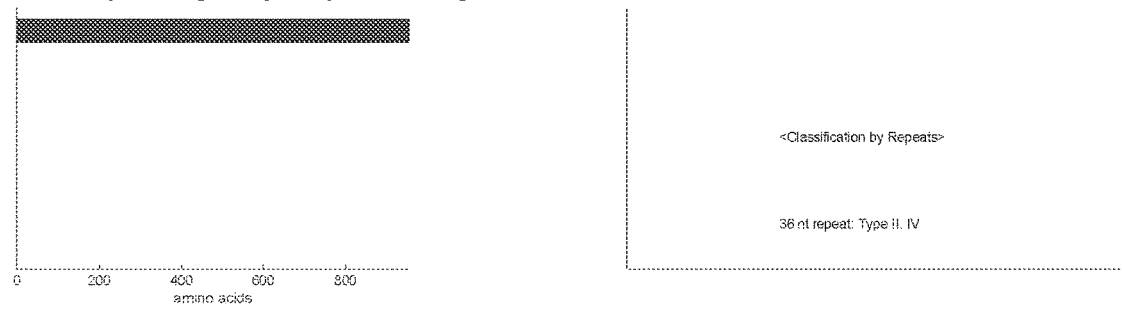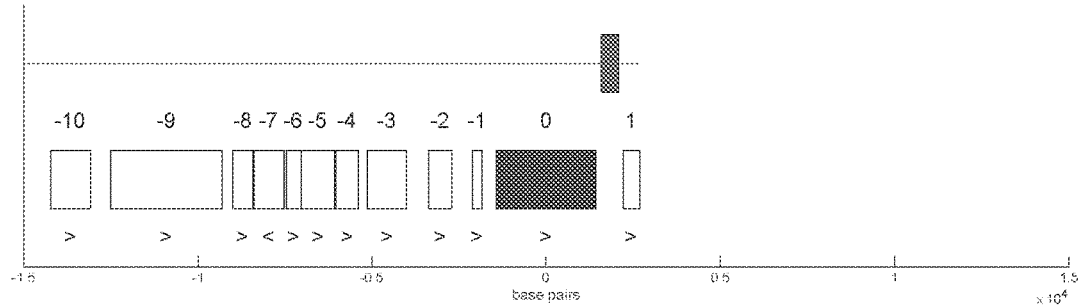
FIG. 4GGGGG

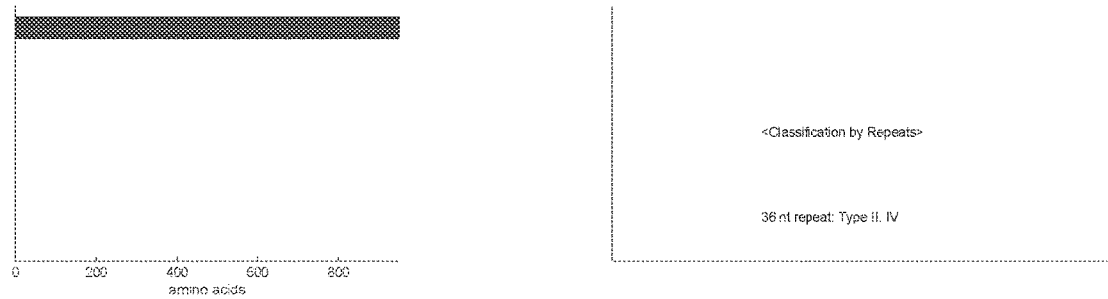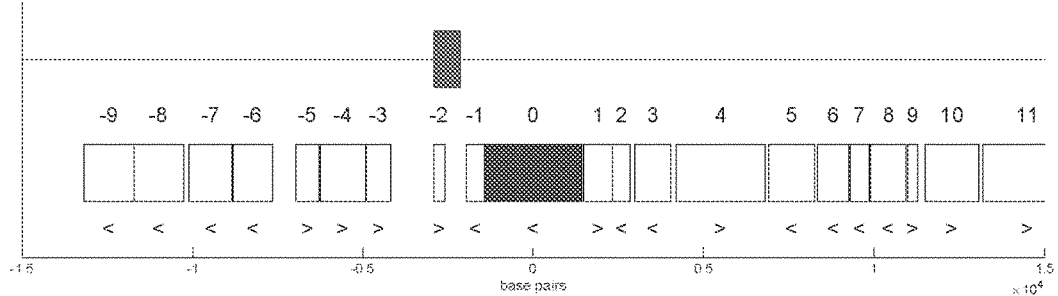
FIG. 4HHHHH

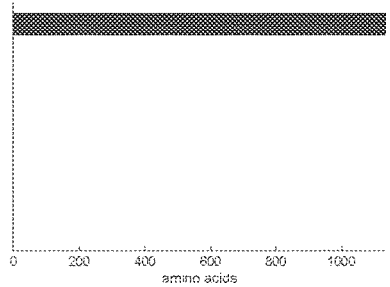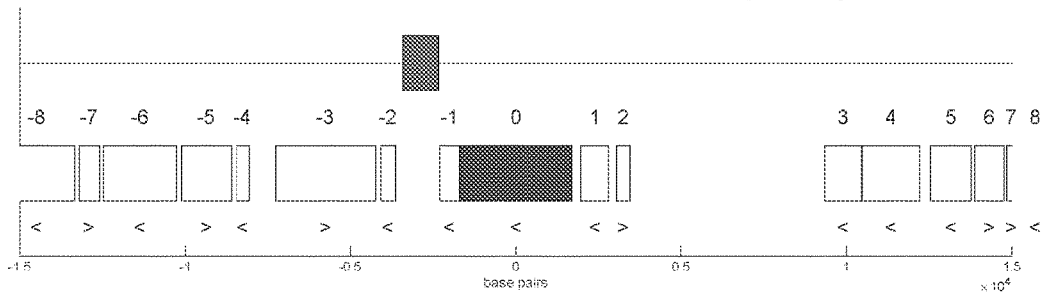
FIG. 4IIIII

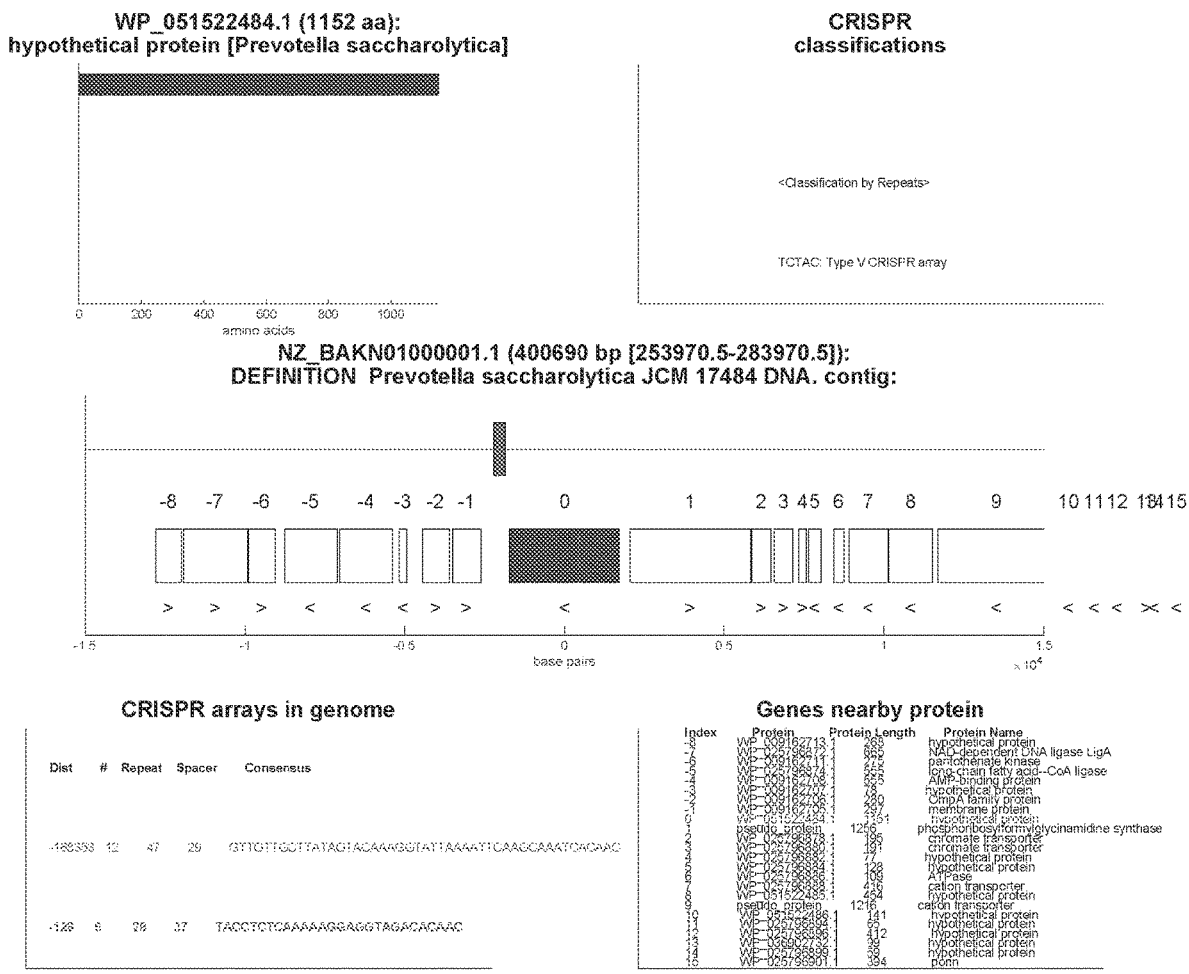
FIG. 4JJJJJ

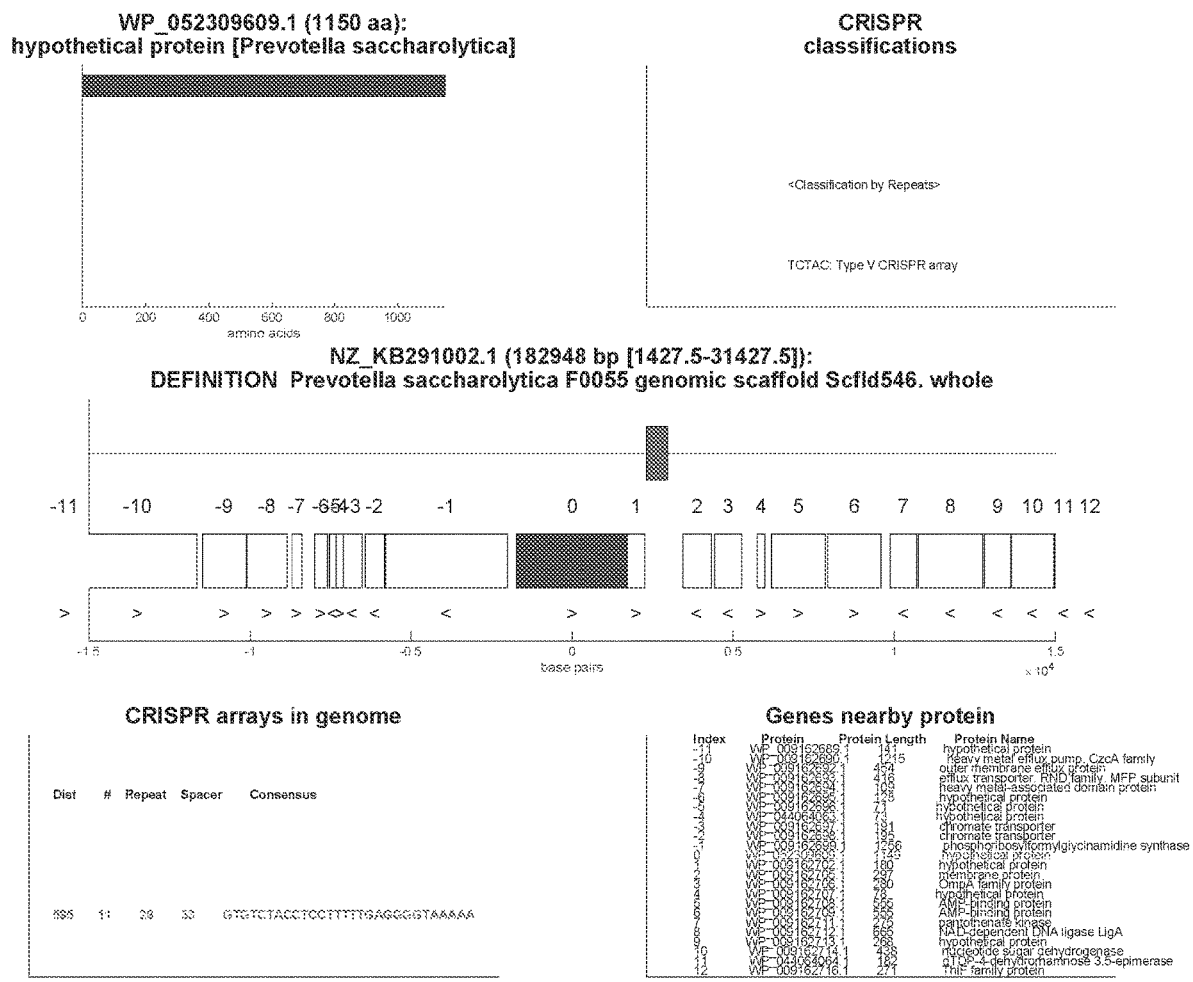
FIG. 4KKKKK

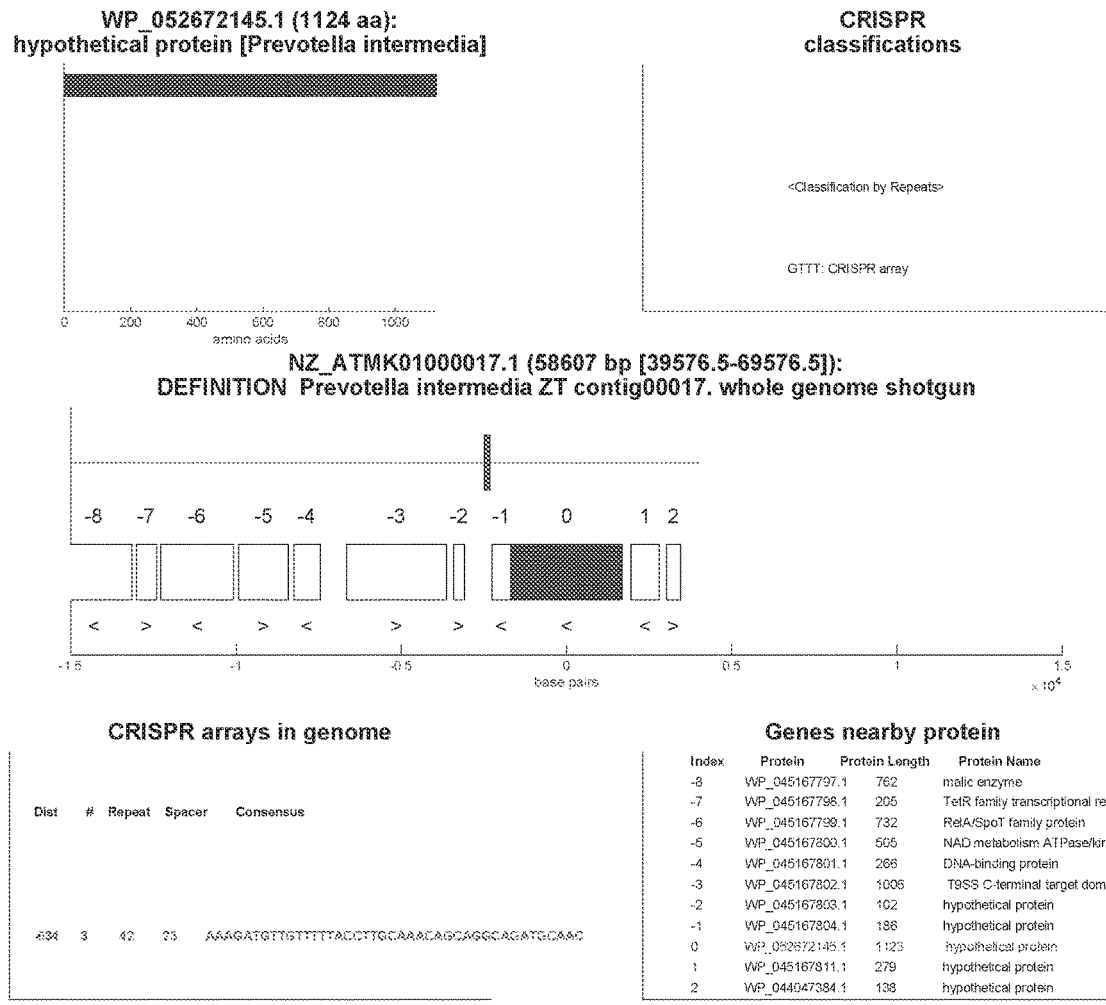
FIG. 4LLLLL

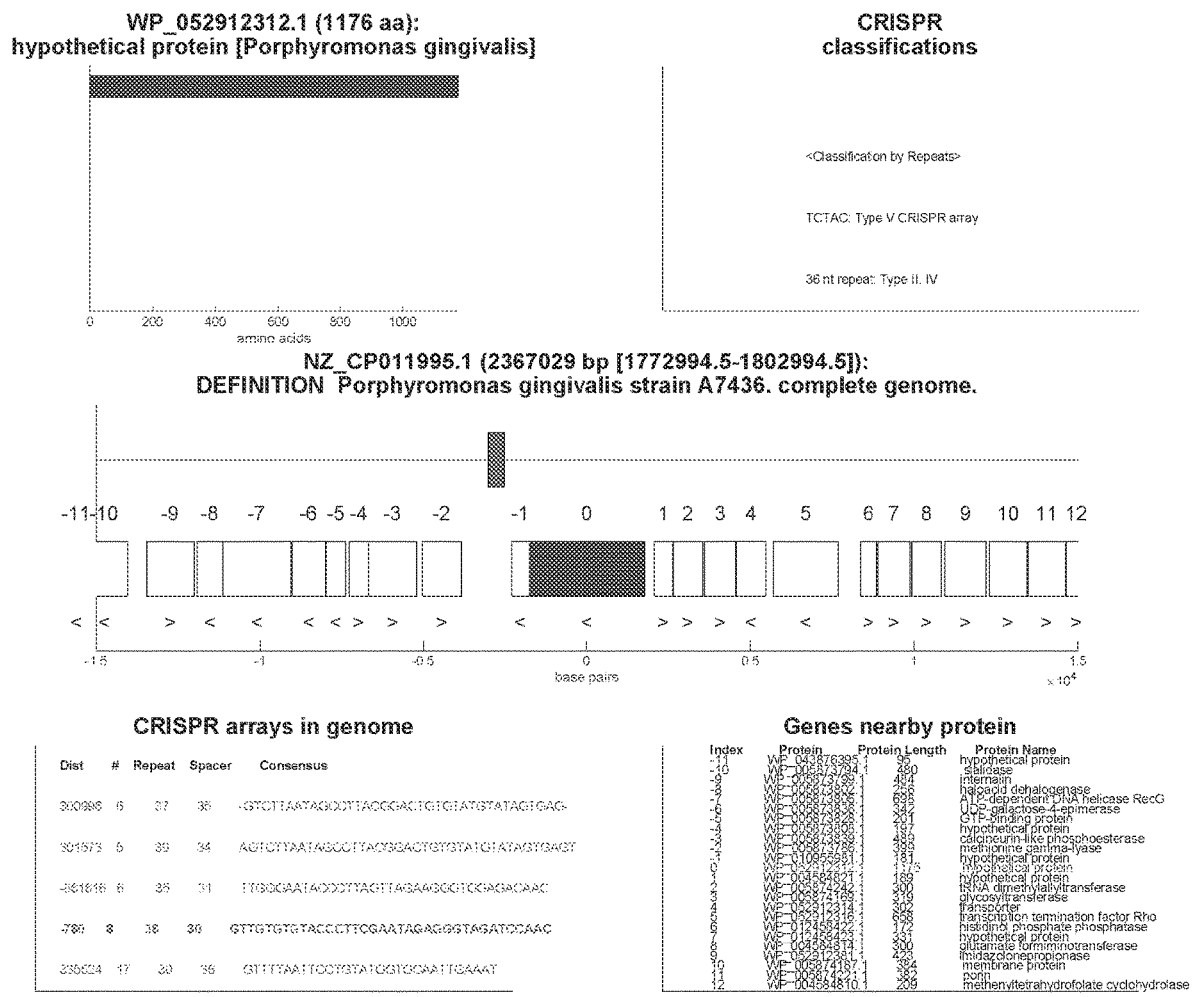
FIG. 4MMMMM

| Protein Accession | Nucleotide Accession | Species | Strain |
|---|---|---|---|
| AFJ07523.1 | CP003502.1 | Prevotella intermedia 17 | 17 |
| EOA10535.1 | APMB01000175.1 | Porphyromonas gingivalis JCVI SC001 | JCVI SC001 |
| WP_002664492.1 | NZ_JH932293.1 | Bergeyella zoohelcum ATCC 43767 | ATCC 43767 |
| EKB54193.1 | AGYA01000037.1 | Bergeyella zoohelcum ATCC 43767 | ATCC 43767 |
| WP_004343581.1 | NZ_GG739967.1 | Prevotella buccae D17 | D17 |
| EFC74556.1 | GG739967.1 | Prevotella buccae D17 | D17 |
| WP_004343973.1 | NZ_GL586311.1 | Prevotella buccae ATCC 33574 | ATCC 33574 |
| EFU31981.1 | AEPD01000005.1 | Prevotella buccae ATCC 33574 | ATCC 33574 |
| WP_004919755.1 | NC_014738.1 | Riemerella anatipestifer ATCC 11845 = DSM 15868 | DSM 15868 |
| AKP69887.1 | CP007503.1 | Riemerella anatipestifer | 17 |
| ADQ82708.1 | CP002346.1 | Riemerella anatipestifer ATCC 11845 = DSM 15868 | DSM 15868 |
| AFD56718.1 | CP003388.1 | Riemerella anatipestifer ATCC 11845 = DSM 15868 | ATCC 11845 |
| ADZ11800.1 | CP002562.1 | Riemerella anatipestifer RA-GD | RA-GD |
| EFT35596.1 | AENH01000026.1 | Riemerella anatipestifer RA-YM | RA-YM |
| AKQ40303.1 | CP007204.1 | Riemerella anatipestifer Yb2 | Yb2 |
| WP_005873511.1 | NC_002950.2 | Porphyromonas gingivalis W83 | W83 |
| AKV64040.1 | CP011995.1 | Porphyromonas gingivalis | A7436 |
| EIW94777.1 | AJZS01000011.1 | Porphyromonas gingivalis W50 | W50 |
| AAQ66265.1 | AE015924.1 | Porphyromonas gingivalis W83 | W83 |
| EIW93190.1 | AJZS01000051.1 | Porphyromonas gingivalis W50 | W50 |
| WP_006044833.1 | NZ_GL982513.1 | Prevotella pallens ATCC 700821 | ATCC 700821 |
| EGQ18444.1 | AFPY01000052.1 | Prevotella pallens ATCC 700821 | ATCC 700821 |
| WP_006259957.1 | NZ_KE161016.1 | Myroides odoratimimus CCUG 10230 | CCUG 10230 |
| EHO06562.1 | AGEC02000017.1 | Myroides odoratimimus CCUG 10230 | CCUG 10230 |
| WP_007412163.1 | NZ_AUQ01000043.1 | Prevotella sp. MSX73 | MSX73 |
| EJP27887.1 | AUQ01000043.1 | Prevotella sp. MSX73 | MSX73 |
| WP_012458151.1 | NC_010729.1 | Porphyromonas gingivalis ATCC 33277 | |
| AIJ35608.1 | CP007756.1 | Porphyromonas gingivalis | HG66 |
| BAG33782.1 | AP009380.1 | Porphyromonas gingivalis ATCC 33277 | ATCC 33277 |
| WP_012458414 | NC_010729.1 | Porphyromonas gingivalis ATCC 33277 | |

FIG. 5A

| Protein Accession | Nucleotide Accession | Species | Strain |
|---|---|---|---|
| .1 | | | |
| BAG34142.1 | AP009380.1 | Porphyromonas gingivalis ATCC 33277 | ATCC 33277 |
| WP_013816155.1 | NC_015571.1 | Porphyromonas gingivalis TDC60 | |
| BAK25606.1 | AP012203.1 | Porphyromonas gingivalis TDC60 | TDC60 |
| WP_013997271.1 | NC_015846.1 | Capnocytophaga canimorsus Cc5 | Cc5 |
| AEK23281.1 | CP002113.1 | Capnocytophaga canimorsus Cc5 | Cc5 |
| WP_014165541.1 | NC_016510.2 | Flavobacterium columnare ATCC 49512 | ATCC 49512 |
| AEW86266.1 | CP003222.2 | Flavobacterium columnare ATCC 49512 | ATCC 49512 |
| WP_015024765.1 | NC_018721.1 | Psychroflexus torquis ATCC 700755 | ATCC 700755 |
| AFU69194.1 | CP003879.1 | Psychroflexus torquis ATCC 700755 | ATCC 700755 |
| WP_015345619.1 | NC_020125.1 | Riemerella anatipestifer RA-CH-2 | RA-CH-2 |
| AKP71852.1 | CP007504.1 | Riemerella anatipestifer | 153 |
| AGC41342.1 | CP004020.1 | Riemerella anatipestifer RA-CH-2 | RA-CH-2 |
| WP_015345620.1 | NC_020125.1 | Riemerella anatipestifer RA-CH-2 | RA-CH-2 |
| AGC41344.1 | CP004020.1 | Riemerella anatipestifer RA-CH-2 | RA-CH-2 |
| ERJ64231.1 | AWUW01000137.1 | Porphyromonas gingivalis F0570 | F0570 |
| ERJ66054.1 | AWUU01000135.1 | Porphyromonas gingivalis F0568 | F0568 |
| ERJ81654.1 | AWVD01000226.1 | Porphyromonas gingivalis F0566 | F0566 |
| WP_021584635.1 | NZ_AWET01000045.1 | Prevotella pleuritidis F0068 | F0068 |
| ERJ98772.1 | AWET01000045.1 | Prevotella pleuritidis F0068 | F0068 |
| WP_021663197.1 | NZ_KI258981.1 | Porphyromonas gingivalis F0568 | F0568 |
| ERJ65637.1 | AWUU01000145.1 | Porphyromonas gingivalis F0568 | F0568 |
| WP_021665475.1 | NZ_KI259168.1 | Porphyromonas gingivalis F0570 | F0570 |
| ERJ66432.1 | AWUW01000078.1 | Porphyromonas gingivalis F0570 | F0570 |
| WP_021677657.1 | NZ_KI259960.1 | Porphyromonas gingivalis F0185 | F0185 |
| WP_021680012.1 | NZ_KI260263.1 | Porphyromonas gingivalis W4087 | W4087 |
| ERJ87335.1 | AWVE01000130.1 | Porphyromonas gingivalis W4087 | W4087 |
| WP_023846767.1 | NZ_KI629875.1 | Porphyromonas gingivalis SJD2 | SJD2 |
| ETA27404.1 | ASYL01000050.1 | Porphyromonas gingivalis SJD2 | SJD2 |

FIG. 5B

| Protein Accession | Nucleotide Accession | Species | Strain |
|---|---|---|---|
| WP_025000926.1 | NZ_BAKF01000019.1 | Prevotella aurantiaca JCM 15754 | JCM 15754 |
| WP_034542281.1 | NZ_BAIU01000001.1 | Bacteroides pyogenes JCM 10003 | |
| GAE20957.1 | BAIU01000001.1 | Bacteroides pyogenes JCM 10003 | JCM 10003 |
| WP_036860899.1 | NZ_JAEZ01000017.1 | Prevotella intermedia ATCC 25611 = DSM 20706 | ATCC 25611 |
| WP_036884929.1 | NZ_BAJY01000004.1 | Prevotella falsenii DSM 22864 = JCM 15124 | JCM 15124 |
| WP_036929175.1 | NZ_JHUW01000010.1 | Prevotella sp. MA2016 | MA2016 |
| WP_036931485.1 | NZ_BAJN01000005.1 | Prevotella pleuritidis JCM 14110 | JCM 14110 |
| WP_039417390.1 | NZ_CP007756.1 | Porphyromonas gingivalis | HG66 |
| AIJ36392.1 | CP007756.1 | Porphyromonas gingivalis | HG66 |
| WP_039418912.1 | NZ_JRAT01000012.1 | Porphyromonas gulae | COT-052 OH3856 |
| KGL48767.1 | JRAT01000012.1 | Porphyromonas gulae | COT-052 OH3856 |
| WP_039419792.1 | NZ_JRAI01000002.1 | Porphyromonas gulae | COT-052 OH1451 |
| KGN88274.1 | JRAI01000002.1 | Porphyromonas gulae | COT-052 OH1451 |
| WP_039426176.1 | NZ_JRAK01000129.1 | Porphyromonas gulae | COT-052 OH3439 |
| KGN85385.1 | JRAK01000129.1 | Porphyromonas gulae | COT-052 OH3439 |
| WP_039428968.1 | NZ_JQZY01000014.1 | Porphyromonas sp. COT-052 OH4946 | COT-052 OH4946 |
| KGL55352.1 | JQZY01000014.1 | Porphyromonas sp. COT-052 OH4946 | COT-052 OH4946 |
| WP_039431778.1 | NZ_JRAJ01000010.1 | Porphyromonas gulae | COT-052 OH2179 |
| KGN69120.1 | JRAJ01000010.1 | Porphyromonas gulae | COT-052 OH2179 |
| WP_039434803.1 | NZ_JRAL01000022.1 | Porphyromonas gulae | COT-052 OH4119 |
| KGN74647.1 | JRAL01000022.1 | Porphyromonas gulae | COT-052 OH4119 |
| KGO05347.1 | JRAF01000001.1 | Porphyromonas gulae | COT-052 OH3498 |
| WP_039442171.1 | NZ_JRFD01000046.1 | Porphyromonas gulae | COT-052 OH2857 |

FIG. 5C

| Protein Accession | Nucleotide Accession | Species | Strain |
|---|---|---|---|
| KGN87312.1 | JRFD01000046.1 | Porphyromonas gulae | COT-052 OH2857 |
| WP_039445055.1 | NZ_JRAQ01000019.1 | Porphyromonas gulae | COT-052 OH3471 |
| KGN76020.1 | JRAQ01000019.1 | Porphyromonas gulae | COT-052 OH3471 |
| WP_041758328.1 | NC_018721.1 | Psychroflexus torquis ATCC 700755 | ATCC 700755 |
| WP_041986150.1 | NZ_CDOK01000122.1 | Capnocytophaga canimorsus | Cc11 |
| CEN50095.1 | CDOK01000122.1 | Capnocytophaga canimorsus | Cc11 |
| WP_041989581.1 | NZ_CDOD01000002.1 | Capnocytophaga cynodegmi | Ccyn2B |
| CEN32480.1 | CDOD01000002.1 | Capnocytophaga cynodegmi | Ccyn2B |
| WP_042518169.1 | NZ_JXQK01000043.1 | Prevotella sp. P5-119 | P5-119 |
| KIP63359.1 | JXQK01000043.1 | Prevotella sp. P5-119 | P5-119 |
| WP_043894148.1 | NZ_KI259080.1 | Porphyromonas gingivalis F0569 | F0569 |
| WP_043894372.1 | NZ_KI259218.1 | Porphyromonas gingivalis F0570 | F0570 |
| WP_043894537.1 | NZ_KI260229.1 | Porphyromonas gingivalis W4087 | W4087 |
| WP_043894751.1 | NZ_KI259867.1 | Porphyromonas gingivalis F0185 | F0185 |
| WP_043895240.1 | NZ_KI260014.1 | Porphyromonas gingivalis F0566 | F0566 |
| WP_043895933.1 | NZ_KI258974.1 | Porphyromonas gingivalis F0568 | F0568 |
| WP_044065294.1 | NZ_JXQL01000055.1 | Prevotella sp. P5-125 | P5-125 |
| KIP62088.1 | JXQL01000055.1 | Prevotella sp. P5-125 | P5-125 |
| WP_044074780.1 | NZ_JXQJ01000080.1 | Prevotella sp. P5-60 | P5-60 |
| KIP58950.1 | JXQJ01000080.1 | Prevotella sp. P5-60 | P5-60 |
| WP_044218239.1 | NZ_JPOS01000018.1 | Phaeodactylibacter xiamenensis | KD52 |
| KGE88582.1 | JPOS01000018.1 | Phaeodactylibacter xiamenensis | KD52 |
| KJJ86756.1 | ATMK01000017.1 | Prevotella intermedia ZT | ZT |
| WP_046201018.1 | NZ_KQ040500.1 | Porphyromonas gulae | COT-052_OH2199 |
| KKC50278.1 | JRAE01000093.1 | Porphyromonas gulae | COT-052_OH2199 |

FIG. 5D

| Protein Accession | Nucleotide Accession | Species | Strain |
|---|---|---|---|
| WP_047447901.1 | NZ_JTLD01000029.1 | Alistipes sp. ZOR0009 | ZOR0009 |
| WP_049354263.1 | NZ_CP007504.1 | Riemerella anatipestifer | |
| AKP71851.1 | CP007504.1 | Riemerella anatipestifer | 153 |
| WP_050955369.1 | NC_017860.1 | Prevotella intermedia 17 | 17 |
| BAR96998.1 | AP014926.1 | Prevotella intermedia | 17-2 |
| WP_051322523.1 | NZ_KE993153.1 | Bacteroides pyogenes F0041 | F0041 |
| WP_051522484.1 | NZ_BAKN01000001.1 | Prevotella saccharolytica JCM 17484 | JCM 17484 |
| WP_052309609.1 | NZ_KB291002.1 | Prevotella saccharolytica F0055 | F0055 |
| WP_052672145.1 | NZ_ATMK01000017.1 | Prevotella intermedia ZT | ZT |
| WP_052912312.1 | NZ_CP011995.1 | Porphyromonas gingivalis | A7436 |
| AKV64762.1 | CP011995.1 | Porphyromonas gingivalis | A7436 |

| # | Prot | Nuc | Species | Strain |
|---|---|---|---|---|
| 1 | WP_002664492.1 | NZ_JH932293.1 | Bergeyella zoohelcum ATCC 43767 | ATCC 43767 |
| 2 | WP_036860899.1 | NZ_JAEZ01000017.1 | Prevotella intermedia ATCC 25611 = DSM 20706 | ATCC 25611 |
| 3 | WP_004343973.1 | NZ_GL586311.1 | Prevotella buccae ATCC 33574 | ATCC 33574 |
| 4 | WP_012458151.1 | NC_010729.1 | Porphyromonas gingivalis ATCC 33277 | ATCC 33277 |
| 5 | WP_034542281.1 | NZ_BAIU01000001.1 | Bacteroides pyogenes JCM 10003 | |
| 6 | WP_047447901.1 | NZ_JTLD01000029.1 | Alistipes sp. ZOR0009 | ZOR0009 |
| 7 | WP_036929175.1 | NZ_JHUW01000010.1 | Prevotella sp. MA2016 | MA2016 |
| 8 | WP_004919755.1 | NC_014738.1 | Riemerella anatipestifer ATCC 11845 = DSM 15868 | DSM 15868 |
| 9 | WP_025000926.1 | NZ_BAKF01000019.1 | Prevotella aurantiaca JCM 15754 | JCM 15754 |
| 10 | WP_051522484.1 | NZ_BAKN01000001.1 | Prevotella saccharolytica JCM 17484 | JCM 17484 |
| 11 | WP_006259957.1 | NZ_KE161016.1 | Myroides odoratimimus CCUG 10230 | CCUG 10230 |
| 12 | WP_014165541.1 | NC_016510.2 | Flavobacterium columnare ATCC 49512 | ATCC 49512 |
| 13 | WP_051322523.1 | NZ_KE993153.1 | Bacteroides pyogenes | F0041 |
| 14 | WP_013997271.1 | NC_015846.1 | Capnocytophaga canimorsus Cc5 | Cc5 |
| 15 | WP_041989581.1 | NZ_CDOD01000002.1 | Capnocytophaga cynodegmi | Ccyn2B |
| 16 | WP_047431796.1 | NZ_KN549099.1 | Chryseobacterium sp. | YR477 |
| 17 | WP_044218239.1 | NZ_JPOS01000018.1 | Phaeodactylibacter xiamenensis | KD52 |
| 18 | WP_043894148.1 | NZ_KI259080.1 | Porphyromonas gingivalis F0569 | F0569 |
| 19 | WP_039445055.1 | NZ_JRAQ01000019.1 | Porphyromonas gulae | COT-052 OH3471 |
| 20 | WP_039434803.1 | NZ_JRAL01000022.1 | Porphyromonas gulae | COT-052 OH4119 |
| 21 | WP_039419792.1 | NZ_JRAI01000002.1 | Porphyromonas gulae | COT-052 OH1451 |
| 22 | WP_036884929.1 | NZ_BAJY01000004.1 | Prevotella falsenii DSM 22864 = JCM 15124 | JCM 15124 |
| 23 | WP_050955369.1 | NC_017860.1 | Prevotella intermedia 17 | 17 |
| 24 | WP_052672145.1 | NZ_ATMK01000017.1 | Prevotella intermedia ZT | ZT |
| 25 | WP_006044833.1 | NZ_GL982513.1 | Prevotella pallens ATCC 700821 | ATCC 700821 |
| 26 | WP_021584635.1 | NZ_AWET01000045.1 | Prevotella pleuritidis F0068 | F0068 |
| 27 | WP_036931485.1 | NZ_BAJN01000005.1 | Prevotella pleuritidis JCM 14110 | JCM 14110 |
| 28 | WP_052309609.1 | NZ_KB291002.1 | Prevotella saccharolytica F0055 | F0055 |
| 29 | WP_042518169.1 | NZ_JXQK01000043.1 | Prevotella sp. P5-119 | P5-119 |
| 30 | WP_015024765.1 | NC_018721.1 | Psychroflexus torquis ATCC 700755 | ATCC 700755 |

FIG. 7

| | |
|---|---|
| 7.7_dr | 72,532  72,541  72,551  72,561  72,567<br>GUUGUAGAAGCUUAUCGUUUGGAUAGGUAUGACAAC<br>repeat region<br>gttgtagaagcttatcgtttggataggtatgacaac |
| 8.8_dr | 1,695,101  1,695,092  1,695,082  1,695,072<br>CUUCGUUAUAUUUCAGCGGAGUUCGUGAAUACUUAA<br>repeat region<br>CTTCGTTATATTTCAGCGGAGTTCGTGAATACT |
| 9.9_dr | 38,944  38,953  38,963  38,973  38,980<br>GUUGUUUUUACCUUCAAACAGAAGGCAGAUACAACA<br>repeat region<br>gttgtttttaccttcaacgtaggcagatacaaca<br>gttgtttttaccttcaacgtaggcagatacaaca<br>tcaaacag |
| 10.10_dr | 266,889  266,898  266,908  266,916<br>UACCUCUCAAAAGGAGGUAGACACAAC<br>repeat region<br>tacctctcaacaggaggtagacacct<br>tcaaaaag |
| 11.11_dr | 204,013  204,004  203,994  203,984  203,977<br>GUUGGUACUGUACACGUUUUUGGUGUGCAAUCACAAC<br>repeat region<br>gttggatgcaccaaaacgtgtacagtaccaac<br>t      caaaaac      a<br>gttgtattgcacaccaaaacgtgtacagtaccaac |
| 12.12_dr | 1,680,165  1,680,174  1,680,184  1,680,194<br>GUUGGAAAGCCCUUAUUUUGAAGGGUAUCUACAAC<br>repeat region<br>gttggaaagcccttattttgaagggtatctacaac |
| 13.13_dr | 246,592  246,601  246,611  246,621  246,627<br>GUUGUGGAUGCCACUAGUUUGAGUGGUAUAGACAAC<br>repeat region<br>gttgtggatgccactagttcgagtggtatagacaac<br>gttgtggatgccactagttgagtggtatagacaac<br>agtttg |

HEPN motif R-X$_{(4-6)}$-H where X is any amino acid

GTTGTAACTGCCCTTATTTGAAGGGTAAACACAAC
GTTGTAACTGCCCTTATTTGAAGGGTAAACACAAC repeat region

FIG. 32

GTTGTAAGTGCCATTCGTTTGAAAGGTAAAAACAAC

FIG. 34

FIG. 39
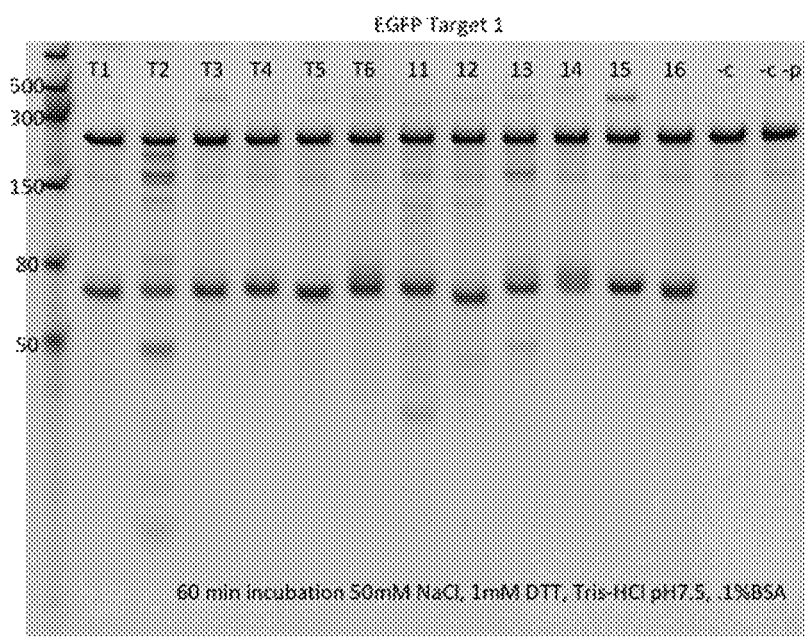
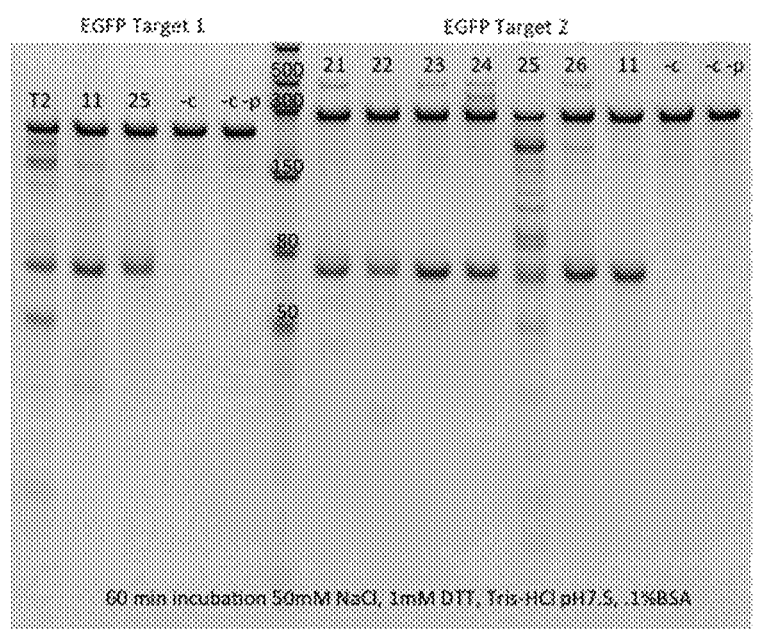

FIG. 40A
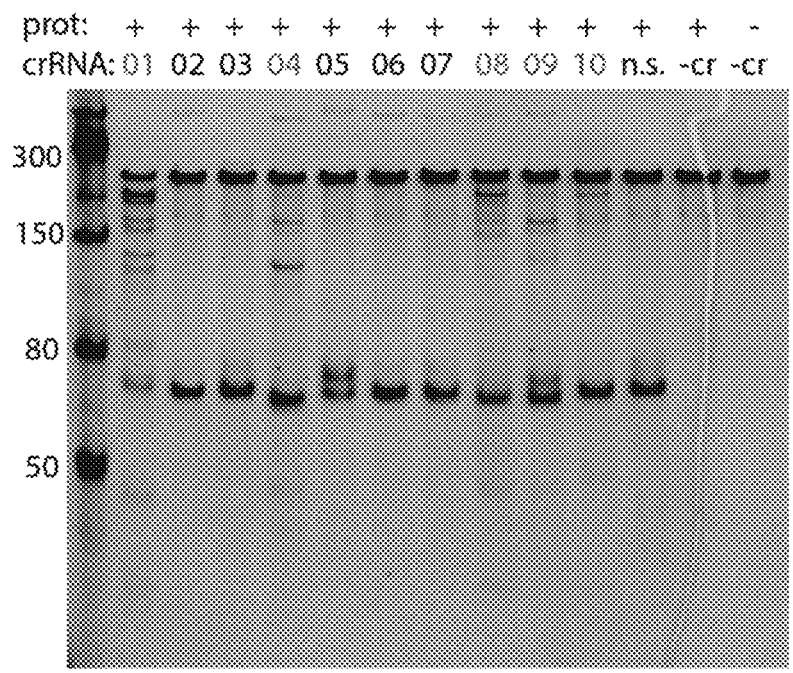
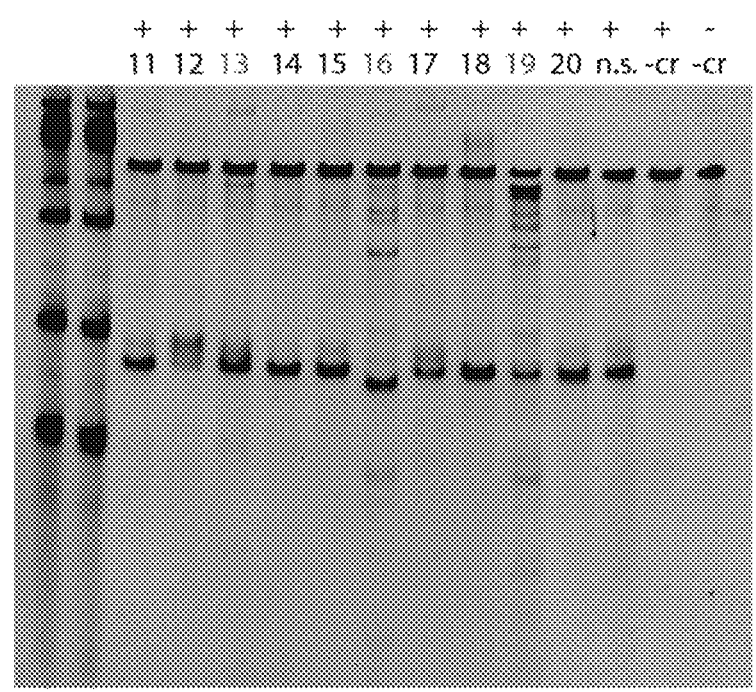

FIG. 40B
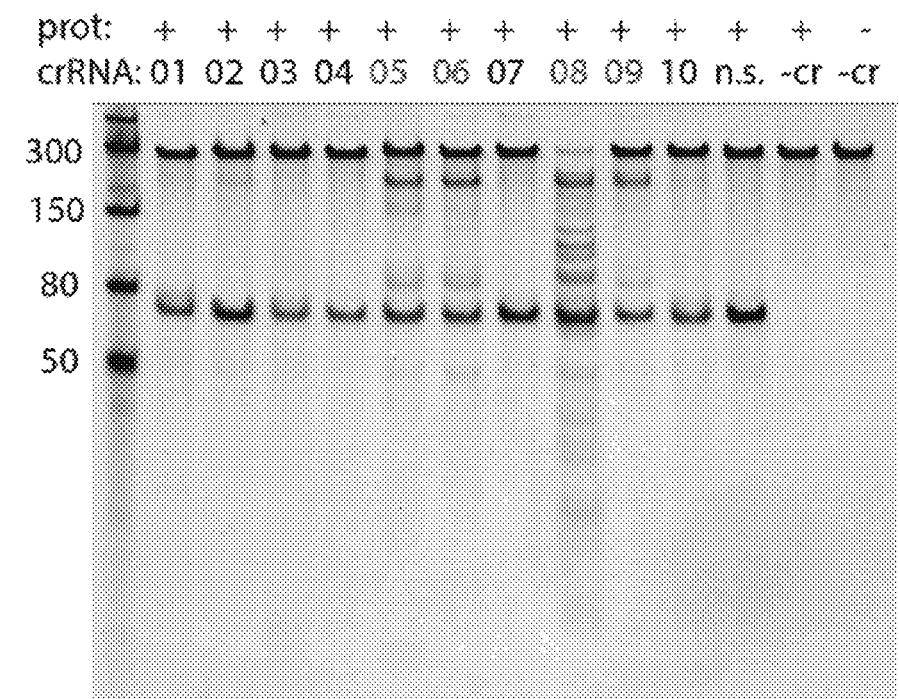
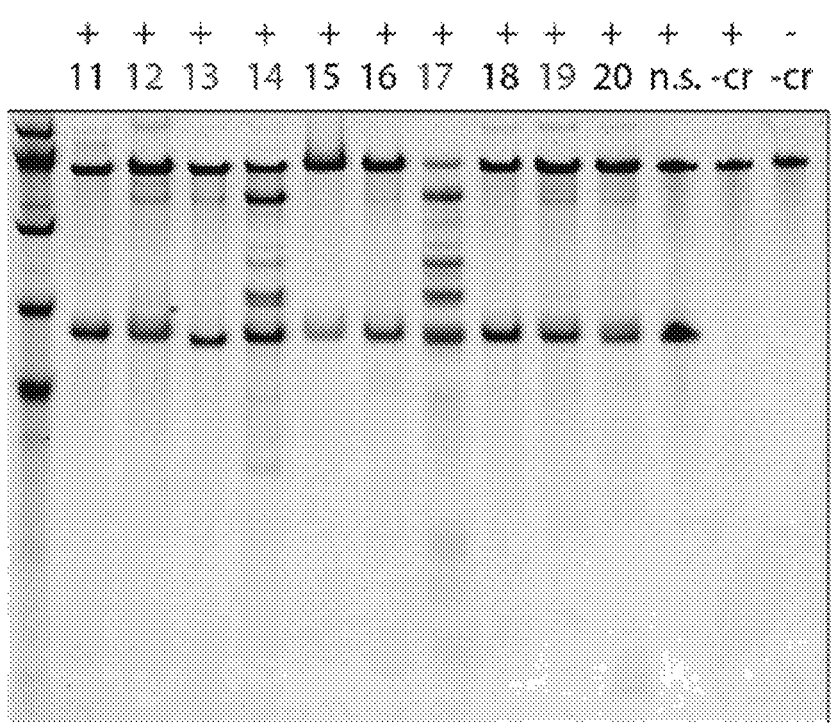

EGFP Target 1

GAUGGGGGUGUUCUGCUGGUAGUGGUCGGCGAGCUGCACGCUGCCGUCCUCGAUGUUGUGGCGGAUCUUG
AAGUUCACCUUGAUGCCGUUCUUCUGCUUGUCGGCCAUGAUAUAGACGUUGUGGCUGUUGUAGUUGUACU
CCAGCUUGUGCCCCAGGAUGUUGCCGUCCUCCUUGAAGUCGAUGCCCUUCAGCUCGAUGCGGUUCACCAG
GGUGUCGCCCUCGAACUUCACCUCGGCGCGGI

EGFP Target 2

CGAGCUGGACGGCGACGUAAACGGCCACAAGUUCAGCGUGUCCGGCGAGGGCGAGGGCGAUGCCACCUAC
GGCAAGCUGACCCUGAAGUUCAUCUGCACCACCGGCAAGCUGCCCGUGCCCUGGCCCACCCUCGUGACCA
CCCUGACCUACGGCGUGCAGUGCUUCAGCCGCUACCCCGACCACAUGAAGCAGCACGACUUCUUCAAGUC
CGCCAUGCCCGAAGGCUACGUCCAGGAGCGCACCAUCUUCUUCAAGGACGACGGCAACUACAAGACCCGC
GCCGAGGUGAAGUUI

FIG. 41

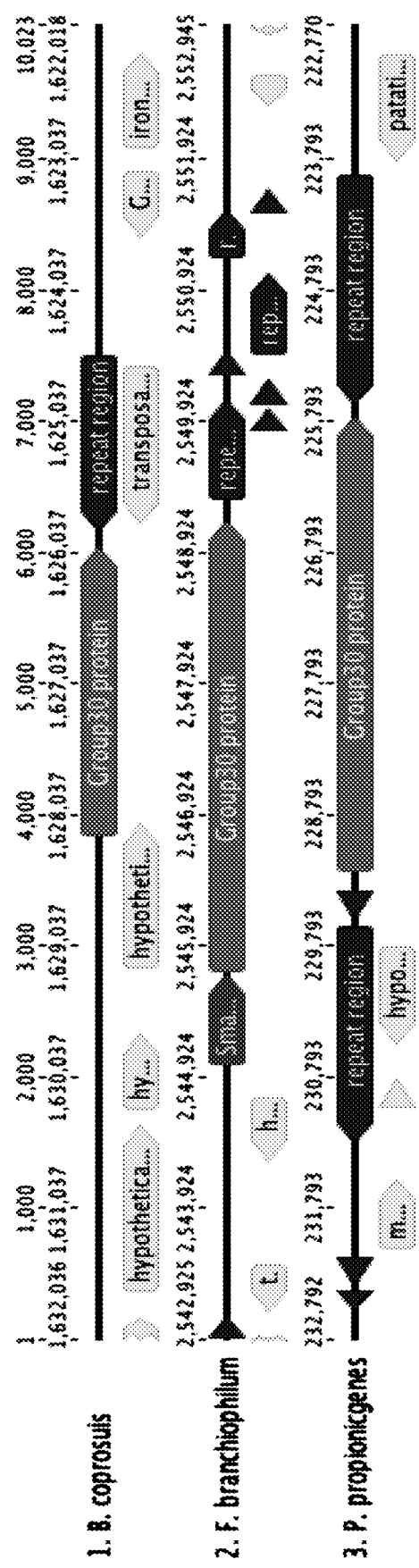
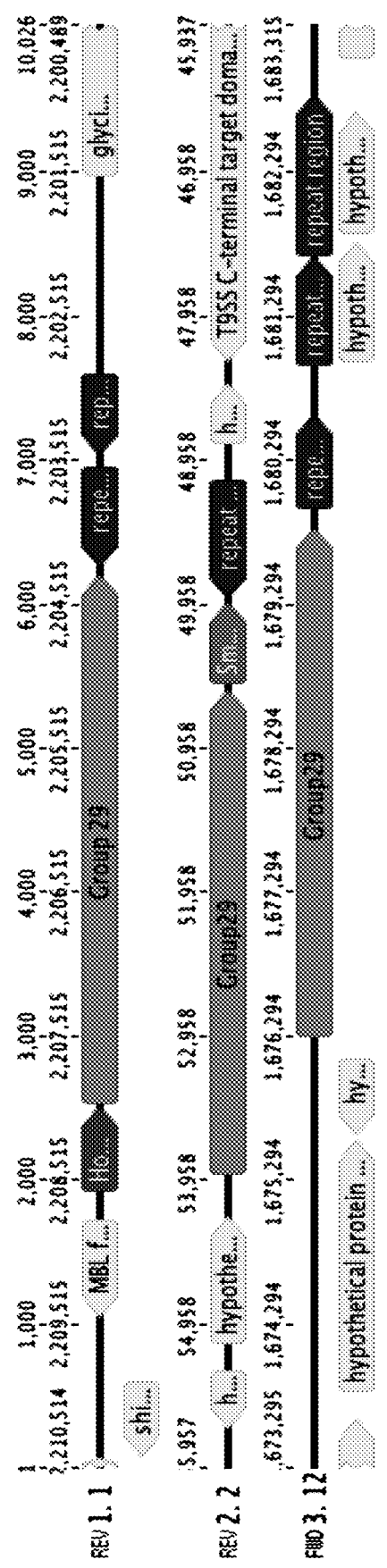
FIG. 43A
FIG. 43B

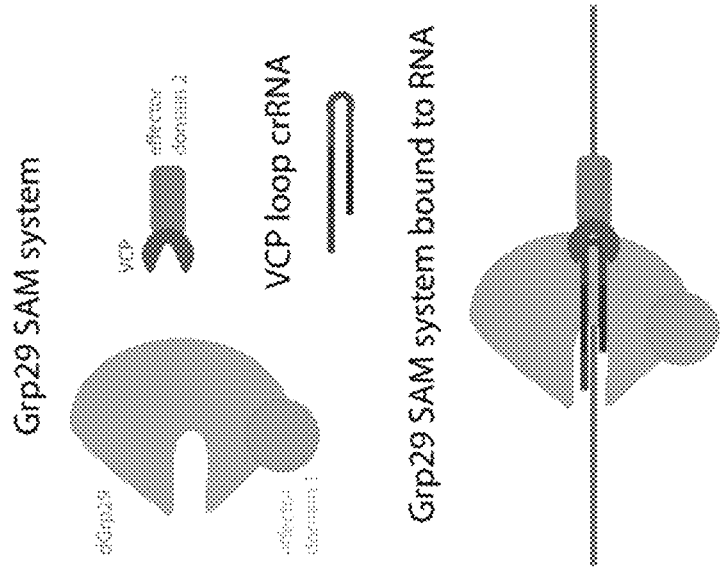
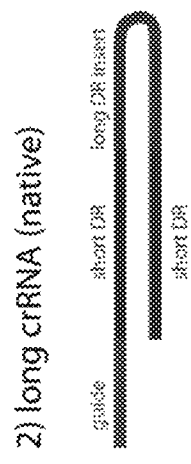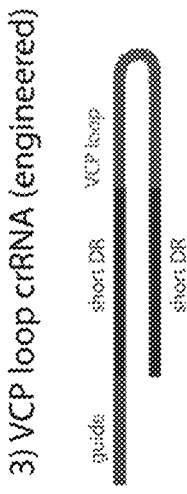
Fig. 45A
Fig. 45B

BZ PFS Wheel

Cutoff of 3
(n=167)

PB PFS Wheel

Cutoff of 2.5
(n=131)

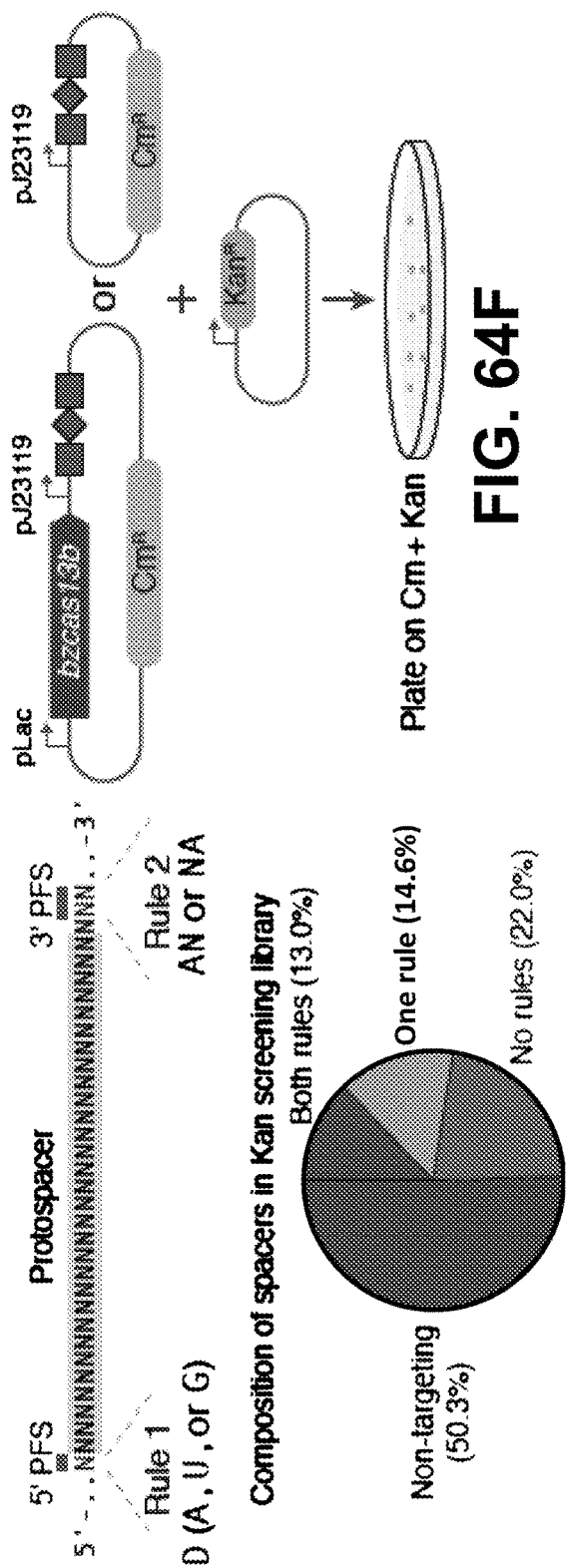
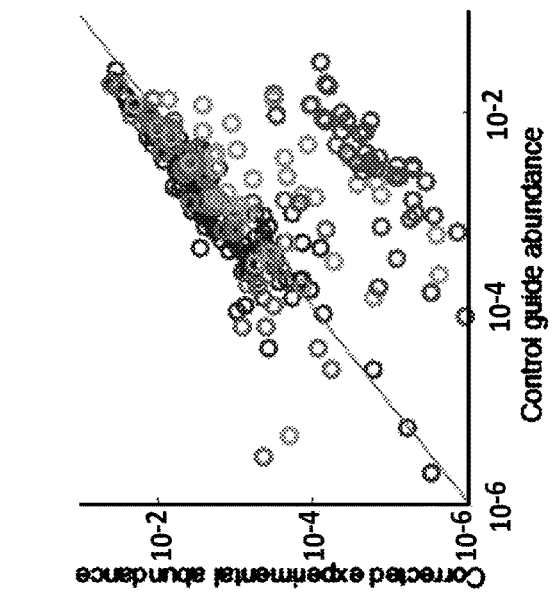
FIG. 64E
FIG. 64F
FIG. 64G

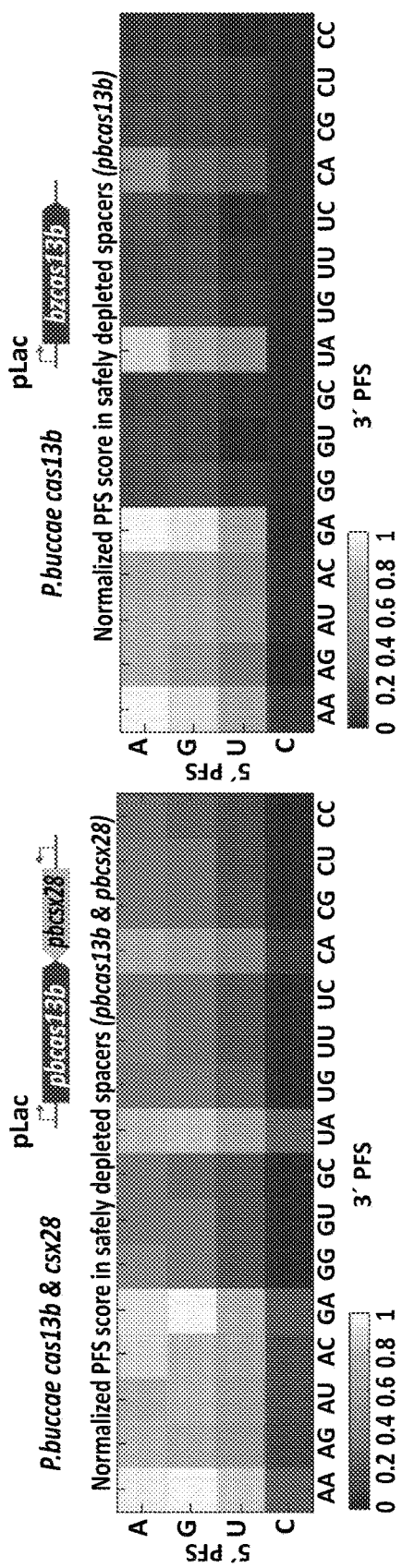
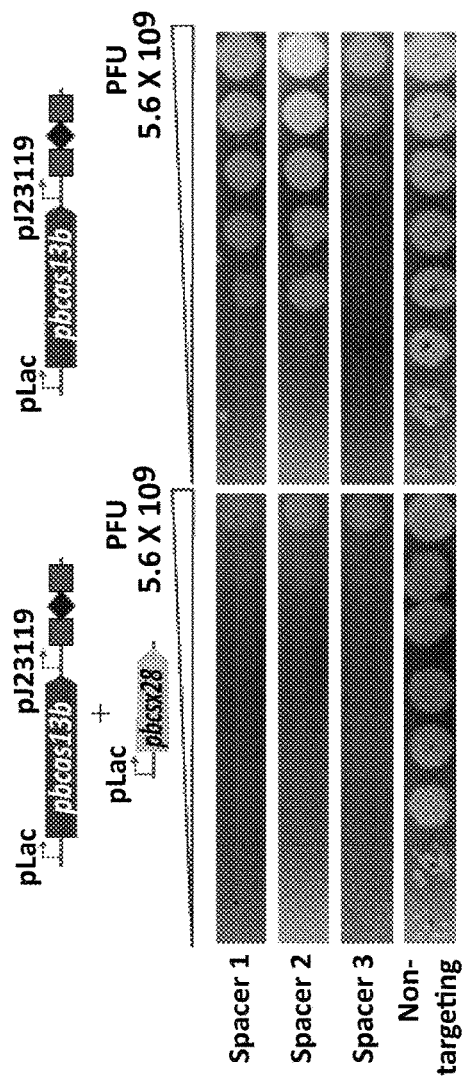
FIG. 67A
FIG. 67B

CRISPR Class 2 Type VI-B Locus 1 direct repeat RNA folds - 36nt*

CRISPR Class 2 Type VI-B Locus 2 direct repeat RNA folds - 36nt

Conservation of 36nt direct repeats (24 unique)

Flanking regions of mapped protospacers (114 unique)

Fig. 71A
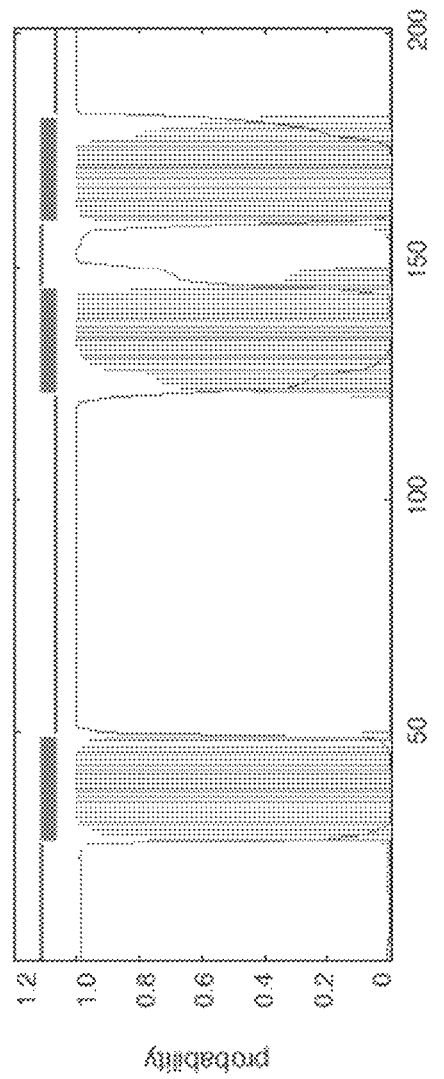
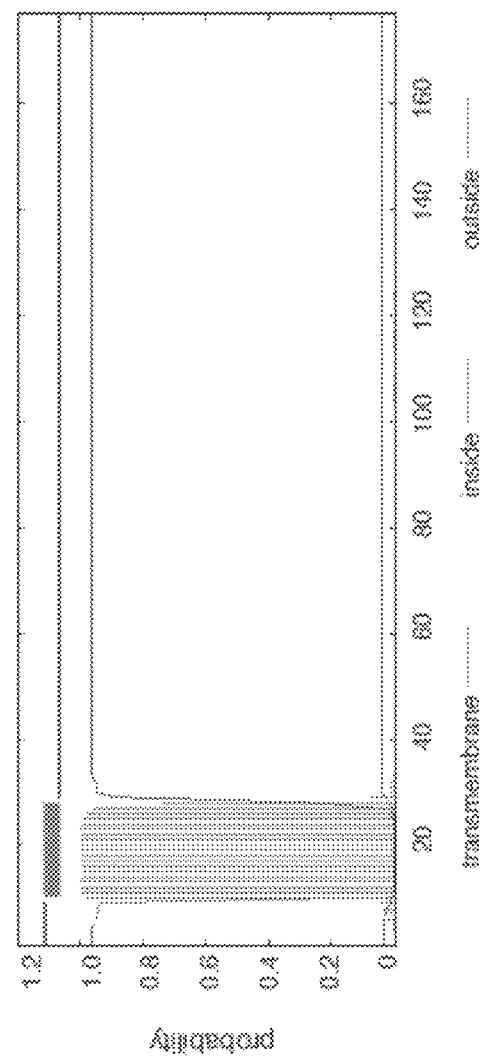

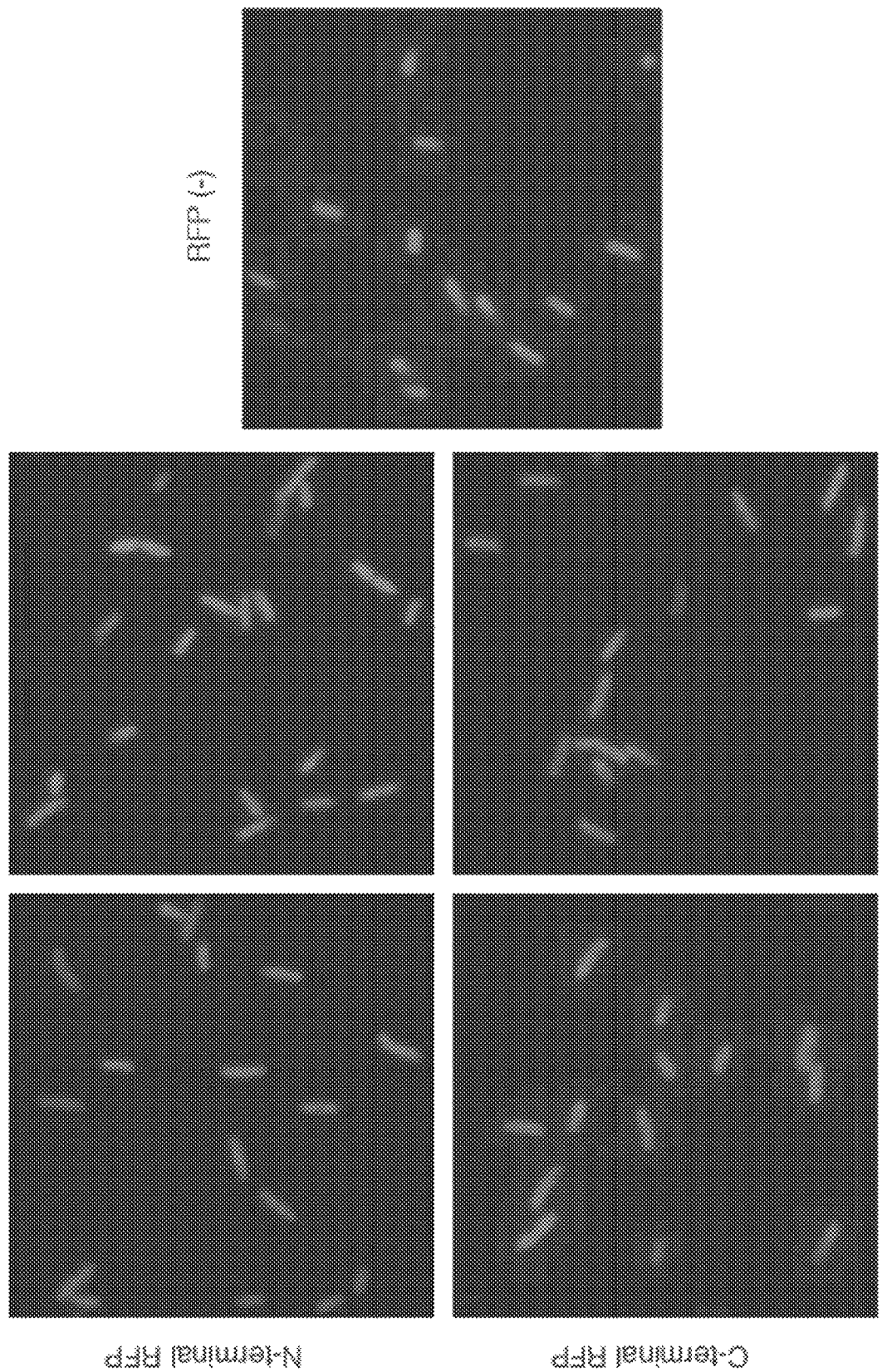

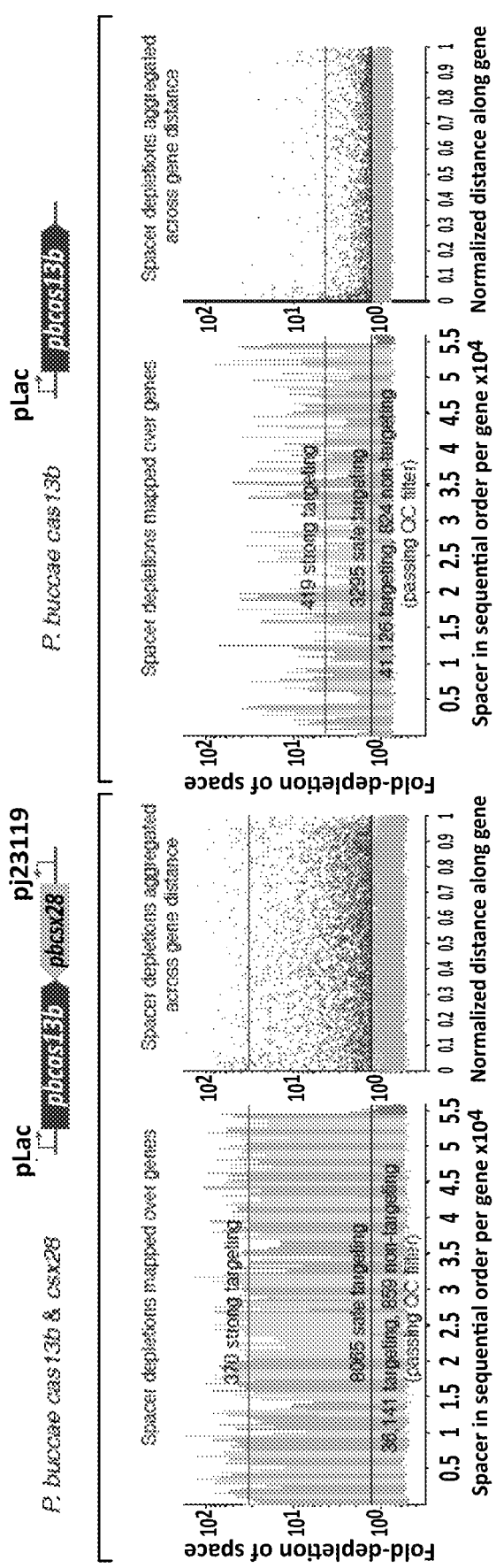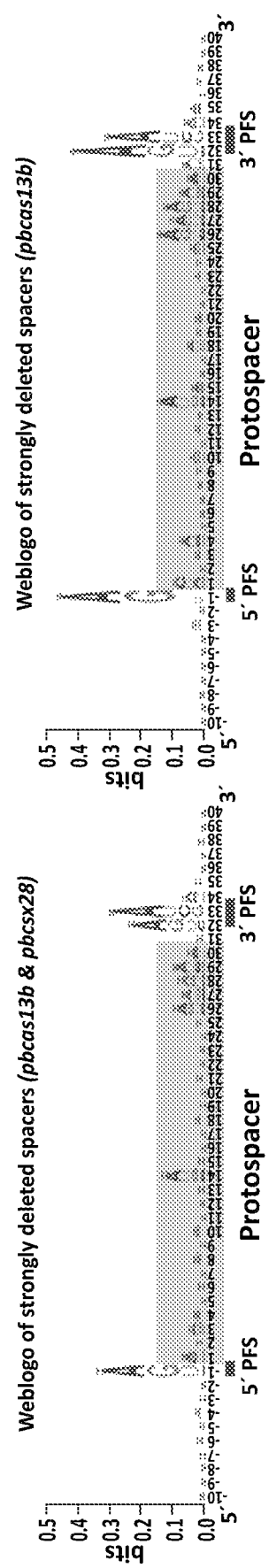
FIG. 75A
FIG. 75B

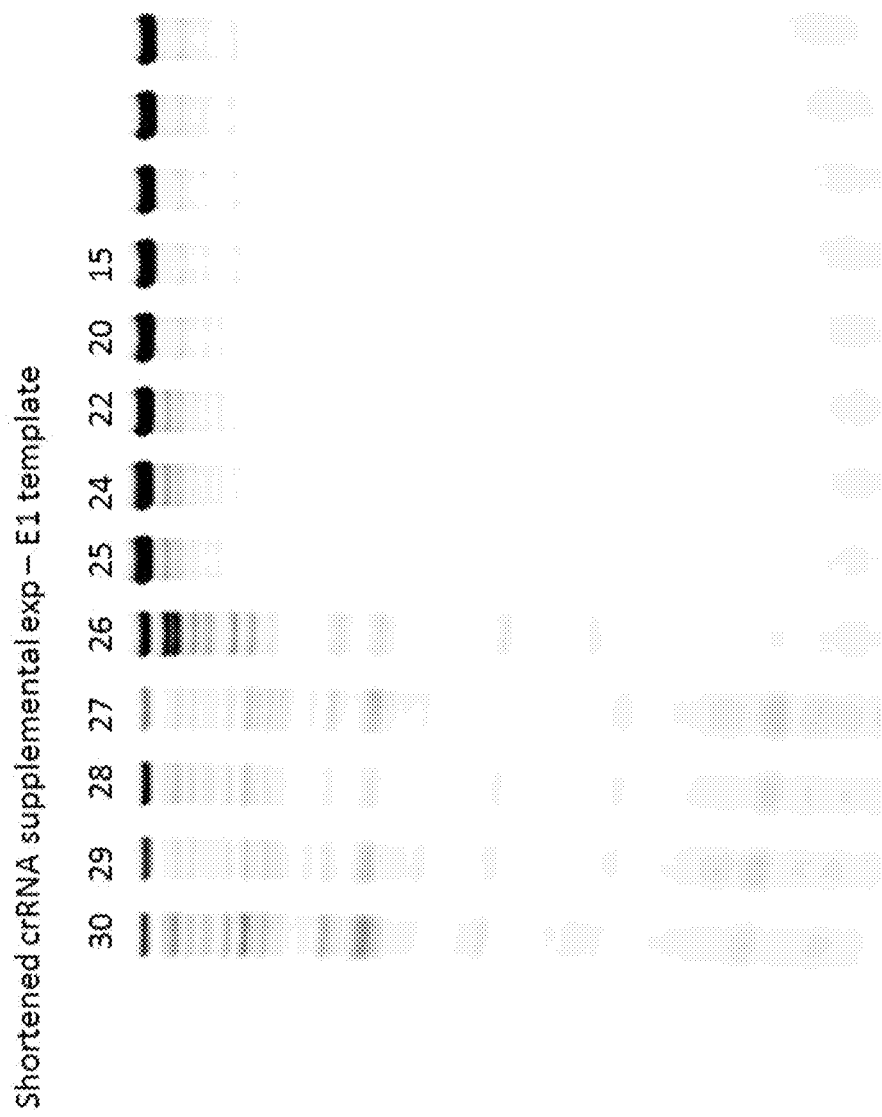

CRISPR ENZYMES AND SYSTEMS

RELATED APPLICATIONS AND INCORPORATION BY REFERENCE

This application claims priority to U.S. Provisional 62/245,270, filed on Oct. 22, 2015, U.S. Provisional 62/296,548, filed on Feb. 17, 2016, U.S. Provisional 62/376,382, filed on Aug. 17, 2016, and U.S. Provisional 62/376,367, filed Aug. 17, 2016.

STATEMENT AS TO FEDERALLY SPONSORED RESEARCH

This invention was made with government support under grant numbers MH100706, DK097768 and MI 10049 awarded by the National Institutes of Health. The government has certain rights in the invention.

All documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FIELD OF THE INVENTION

The present invention generally relates to systems, methods and compositions used for the control of gene expression involving sequence targeting, such as perturbation of gene transcripts or nucleic acid editing, that may use vector systems related to Clustered Regularly Interspaced Short Palindromic Repeats (CRISPR) and components thereof.

BACKGROUND OF THE INVENTION

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that employ novel strategies and molecular mechanisms and are affordable, easy to set up, scalable, and amenable to targeting multiple positions within the eukaryotic genome. This would provide a major resource for new applications in genome engineering and biotechnology.

The CRISPR-CRISPR associated (Cas) systems of bacterial and archaeal adaptive immunity are some such systems that show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein (FIGS. 1A and 1B). Novel effector proteins associated with Class 2 CRISPR-Cas systems may be developed as powerful genome engineering tools and the prediction of putative novel effector proteins and their engineering and optimization is important.

However, no researcher has undertaken a Cas protein-agnostic approach to identify novel single-effector systems. Doing so requires an unbiased and comprehensive bioinformatic analysis of all prokaryotic genomes and an accompanying sophisticated annotation methodology, and would potentially exhaust the possibility space for RNA-programmable CRISPR single effectors. The present application adopts such an approach and utilizes the ever-growing number of publicly accessible bacterial genomes and changing CRISPR rules to identify novel effector proteins that have expanded genome engineering capabilities.

Citation or identification of any document in this application is not an admission that such document is available as prior art to the present invention.

SUMMARY OF THE INVENTION

There exists a pressing need for alternative and robust systems and techniques for targeting nucleic acids or polynucleotides (e.g. DNA or RNA or any hybrid or derivative thereof) with a wide array of applications. This invention addresses this need and provides related advantages. Adding the novel DNA or RNA-targeting systems of the present application to the repertoire of genomic and epigenomic targeting technologies may transform the study and perturbation or editing of specific target sites through direct detection, analysis and manipulation. To utilize the DNA or RNA-targeting systems of the present application effectively for genomic or epigenomic targeting without deleterious effects, it is critical to understand aspects of engineering and optimization of these DNA or RNA targeting tools.

The invention provides computational methods for identifying and classifying new single effector protein systems that have applications in editing and modulating nucleic acids, expression products or genomes. In a preferred embodiment of the invention, the single effector protein does not have a proximate Cas protein (e.g. Cas1 or Cas2) in its corresponding locus. In an embodiment of the invention, the single effector protein comprises a Class 2 Type VI-B effector protein. Class 2 Type VI-B effector proteins include two subgroups, Type VI-B1 and Type VI-B2, which are also referred to as Group 29 proteins and Group 30 proteins, and include members which are RNA-programmable nucleases, RNA-interfering and may be involved in bacterial adoptive immunity against RNA phages.

Group 29 and group 30 systems comprise a large single effector (approximately 1100 amino acids in length), termed Cas13b, and one or none of two small putative accessory proteins (approximately 200 amino acids in length) nearby a CRISPR array. Based on the nearby small protein, the system is bifurcated into two Loci A and B. No additional proteins out to 25 kilobase pairs upstream or downstream from the array are conserved across species with each locus. With minor exceptions, the CRISPR array comprises direct repeat sequences 36 nucleotides in length and spacer sequences 30 nucleotides in length. The direct repeat is generally well conserved, especially at the ends, with a GTTG/GUUG at the 5' end reverse complementary to a CAAC at the 3' end. This conservation suggests strong base pairing for an RNA loop structure that potentially interacts with the protein(s) in the locus. A motif search complementary to the direct repeats revealed no candidate tracrRNAs nearby the arrays, possibly indicative of a single crRNA like that found in the Cpf1 locus.

In embodiments of the invention, a Type VI-B system (e.g., a Group 29 or group 30 system) comprises a Cas13b effector protein and optionally a small accessory protein encoded upstream or downstream of the Cas13b effector protein. In certain embodiments, the small accessory protein enhances the Cas13b effector's ability to target RNA.

In certain embodiments of the invention, a Group 29 or group 30 system comprises a Cas13b effector protein and optionally a small accessory protein encoded upstream or downstream of the Cas13b effector protein. In certain embodiments, the small accessory protein repressses the Cas13b effector's ability to target RNA.

The invention provides a non-naturally occurring or engineered composition comprising i) a Type VI-B CRISPR-Cas effector protein, and ii) a Type VI-B CRISPR-Cas crRNA, wherein the crRNA comprises a) a guide sequence that is capable of hybridizing to a target RNA sequence, and b) a direct repeat sequence. The Type VI-B CRISPR-Cas effector protein forms a complex with the crRNA, and the guide sequence directs sequence-specific binding of the complex to the target RNA sequence, whereby there is formed a CRISPR complex comprising the Type VI-B CRISPR-Cas effector protein complexed with the guide sequence that is hybridized to the target RNA sequence. The complex that is formed when the guide sequence hybridizes to the target RNA sequence includes interaction (recognition) of the protospacer flanking sequence (PFS).

In some embodiments, a non-naturally occurring or engineered composition of the invention may comprise a Type VI-B CRISPR-Cas accessory protein that enhances Type VI-B CRISPR-Cas effector protein activity. In certain such embodiments, the accessory protein that enhances Type VI-B CRISPR-Cas effector protein activity is a csx28 protein. In such embodiments, the Type VI-B CRISPR-Cas effector protein and the Type VI-B CRISPR-Cas accessory protein may be from the same source or from a different source.

In some embodiment, a non-naturally occurring or engineered composition of the invention comprises a Type VI-B CRISPR-Cas accessory protein that represses Type VI-B CRISPR-Cas effector protein activity. In certain such embodiment, the accessory protein that represses Type VI-B CRISPR-Cas effector protein activity is a csx27 protein. In such embodiments, the Type VI-B CRISPR-Cas effector protein and the Type VI-B CRISPR-Cas accessory protein may be from the same source or from a different source. In certain embodiments of the invention, the Type VI-B CRISPR-Cas effector protein is from Table 1. In certain embodiments, the Type VI-B CRISPR-Cas accessory protein is from Table 1.

In some embodiments, a non-naturally occurring or engineered composition of the invention comprises two or more Type VI-B CRISPR-Cas crRNAs.

In some embodiments, a non-naturally occurring or engineered composition of the invention comprises a guide sequence that hybridizes to a target RNA sequence in a prokaryotic cell. In some embodiments, a non-naturally occurring or engineered composition of the invention comprises a guide sequence that hybridizes to a target RNA sequence in a eukaryotic cell. In some embodiment, the Type VI-B CRISPR-Cas effector protein comprises one or more nuclear localization signals (NLSs).

In some embodiment of the non-naturally occurring or engineered composition of the invention, the Type VI-B CRISPR-Cas effector protein is associated with one or more functional domains. The association can be by direct linkate of the effector protein to the functional domain, or by association with the crRNA. In a non-limiting example, the crRNA comprises an added or inserted sequence that can be associated with a functional domain of interest, including, for example, an aptamer or a nucleotide that binds to a nucleic acid binding adapter protein.

In certain non-limiting embodiments, a non-naturally occurring or engineered composition of the invention comprises a functional domain cleaves the target RNA sequence. In certain non-limiting embodiments, the non-naturally occurring or engineered composition of the invention comprises a functional domain that modifies transcription or translation of the target RNA sequence.

In some embodiment of the composition of the invention, the Type VI-B CRISPR-Cas effector protein is associated with one or more functional domains; and the effector protein contains one or more mutations within an HEPN domain, whereby the complex can deliver an epigenetic modifier or a transcriptional or translational activation or repression signal.

The invention also provides a Type VI-B CRISPR-Cas vector system, which comprises one or more vectors comprising a first regulatory element operably linked to a nucleotide sequence encoding the Type VI-B CRISPR-Cas effector protein, and a second regulatory element operably linked to a nucleotide sequence encoding the Type VI-B CRISPR-Cas crRNA. In certain embodiments, the vector system of the invention further comprises a regulatory element operably linked to a nucleotide sequence of a Type VI-B CRISPR-Cas accessory protein. When appropriate, the nucleotide sequence encoding the Type VI-B CRISPR-Cas effector protein and/or the nucleotide sequence encoding the Type VI-B CRISPR-Cas accessory protein are codon optimized for expression in a host cell, such as, for example, a eukaryotic cell.

In some embodiments, the vector system of the invention comprises a single vector. In other embodiments, the vector system comprises two or more vectors. In certain embodiments, the single vector, or the two or more vectors, comprise one or more viral vectors. Non-limiting examples of viral vectors include retroviral, lentiviral, adenoviral, adeno-associated or herpes simplex viral vectors.

Also provided is a delivery system configured to deliver a Type VI-B CRISPR-Cas effector protein and one or more nucleic acid components of a non-naturally occurring or engineered composition comprising i) a Type VI-B CRISPR-Cas effector protein, and ii) a Type VI-B CRISPR-Cas crRNA, wherein the crRNA comprises a) a guide sequence that hybridizes to a target RNA sequence in a cell, and b) a direct repeat sequence, wherein the Type VI-B CRISPR-Cas system effector protein forms a complex with the crRNA, and wherein the guide sequence directs sequence-specific binding to the target RNA sequence, to form a CRISPR complex comprising the Type VI-B CRISPR-Cas effector protein complexed with the guide sequence that is hybridized to the target RNA sequence. Optionally, the delivery system delivers a Type VI-B CRISPR-Cas accessory protein. The system may be designed to deliver the components separately, for example at different times or under different conditions, of to deliver the components together.

In various embodiments, the delivery system comprises one or more vectors or one or more polynucleotide molecules, or combinations of one or more vectors and polynucleotide molecules, or combinations of one or more vectors, one or more polynucleotide molecules, Type VI-B CRISPR-Cas effector proteins, and Type VI-B CRISPR-Cas accessory proteins.

In certain embodiments, the delivery system of the invention comprises a delivery vehicle comprising liposome(s), particle(s), exosome(s), microvesicle(s), a gene-gun or one or more viral vector(s).

In some embodiments, the non-naturally occurring or engineered composition of the invention is for use in a therapeutic method of treatment. In some embodiments, the non-naturally occurring or engineered vector system of the invention is for use in a therapeutic method of treatment. In some embodiment, the non-naturally occurring or engineered delivery system of the invention is for use in a therapeutic method of treatment.

The invention provides a method of modifying expression of a target gene of interest, the method comprising contacting a target RNA with one or more non-naturally occurring or engineered compositions comprising i) a Type VI-B CRISPR-Cas effector protein, and ii) a Type VI-B CRISPR-Cas crRNA, wherein the crRNA comprises a) a guide sequence that hybridizes to a target RNA sequence in a cell, and b) a direct repeat sequence, wherein the Type VI-B CRISPR-Cas system effector protein forms a complex with the crRNA, wherein the guide sequence directs sequence-specific binding to the target RNA sequence in a cell, whereby there is formed a CRISPR complex comprising the Type VI-B CRISPR-Cas effector protein complexed with the guide sequence that is hybridized to the target RNA sequence, whereby expression of the target locus of interest is modified.

In ceratin embodiments, the method of modifying expression of a target gene of interest further comprises contacting the target RNA with a Type VI-B CRISPR-Cas accessory protein that enhances Type VI-B CRISPR-Cas effector protein activity, such as a csx28 protein, non-limiting examples of which are provided.

In certain embodiments, the method of modifying expression of a target gene of interest further comprises contacting the target RNA with a Type VI-B CRISPR-Cas accessory protein that represses Type VI-B CRISPR-Cas effector protein activity, such as a csx27 protein, non-limiting examples of which are provided.

In some embodiments, modifying expression of a target gene of interest comprises cleaving the target RNA. In some embodiments, modifying expression of a target gene of interest comprises increasing or decreasing expression of the target RNA. In certain embodiments, modifying expression of a target gene causes increased or decreased expression of non-target components of a cell. In certain embodiments, the cell is a prokaryotic cell. In other embodiments, the target cell is a eukaryotic cell, non-limiting examples of which include plant cells and tissues, animal cells and tissues, and human cells and tissues.

The invention provides a cell, tissue or organism comprising a modified target of interest, wherein the target of interest has been modified according to any of the method disclosed herein. In some embodiment, modification of the target of interest in a cell results in: a cell comprising altered expression of at least one gene product; a cell comprising altered expression of at least one gene product, wherein the expression of the at least one gene product is increased; or a cell comprising altered expression of at least one gene product, wherein the expression of the at least one gene product is decreased. Non-limiting examples include mammalian cell, human cell, and plant cells. The invention also provides a cell line of a cell disclosed herein or a cell modified by any of the methods disclosed herein, or progeny thereof.

The invention provides a multicellular organism comprising one or more cells disclosed herein or one or more cells modified according to any of the methods disclosed herein. The invention provides a plant or animal model comprising one or more cells disclosed herein or one or more cells modified according to any of the methods disclosed herein. The invention provides a gene product from a cell or the cell line or the organism or the plant or animal model disclosed herein. In some embodiment, the amount of gene product expressed is greater than or less than the amount of gene product from a cell that does not have altered expression.

The invention provides an isolated Type VI-B CRISPR-Cas effector protein. In non-limiting embodiments, the isolated Type VI-B CRISPR-Cas effector protein is from a micro-organism selected from *Bergeyella zoohelcum* or *Prevotella buccae*. The invention provides an isolated Type VI-B CRISPR-Cas accessory protein. In non-limiting embodiments, the isolated Type VI-B CRISPR-Cas accessory protein is from a micro-organism selected from *Bergeyella zoohelcum* or *Prevotella buccae*.

The invention provides an isolated nucleic acid encoding the Type VI-B CRISPR-Cas effector protein, as well as an isolated nucleic acid endoding the Type VI-B CRISPR-Cas accessory protein. In a non-limiting example, the isolated nucleic acid encodes a Type VI-B CRISPR-Cas effector protein from a micro-organism selected from *Bergeyella zoohelcum* or *Prevotella buccae*. The isolated nuicleic acid can be DNA or RNA. Also provided is an isolated cell comprising the nucleic acid encoding the Type VI-B CRISPR-Cas effector protein or accessory protein.

The invention provides a method of identifying the requirements of a suitable guide sequence for an RNA-targeting protein, said method comprising:
 (a) selecting a set of essential genes within an organism
 (b) designing a library of targeting guide sequences capable of hybridizing to regions the coding regions of these genes as well as 5' and 3' UTRs of these genes
 (c) generating randomized guide sequences that do not hybridize to any region within the genome of said organism as control guides
 (d) preparing a plasmid comprising the RNA-targeting protein and a first resistance gene and a guide plasmid library comprising said library of targeting guides and said control guides and a second resistance gene,
 (e) co-introducing said plasmids into a host cell
 (f) introducing said host cells on a selective medium for said first and second resistance genes
 (g) sequencing essential genes of growing host cells
 (h) determining significance of depletion of cells transformed with targeting guides by comparing depletion of cells with control guides; and
 (i) determining based on the depleted guide sequences the requirements of a suitable guide sequence.

In one aspect of such method, determining the PFS sequence for suitable guide sequence of the RNA-targeting protein is by comparison of sequences targeted by guides in depleted cells.

In one aspect of such method, the method further comprises comparing the guide abundance for the different conditions in different replicate experiments.

In one aspect of such method, the control guides are selected in that they are determined to show limited deviation in guide depletion in replicate experiments.

In one aspect of such method, the significance of depletion is determined as (a) a depletion which is more than the most depleted control guide; or (b) a depletion which is more than the average depletion plus two times the standard deviation for the control guides.

In one aspect of such method, the host cell is a bacterial host cell.

In one aspect of such method, the step of co-introducing the plasmids is by electroporation and the host cell is an electro-competent host cell.

The invention provides a method of modifying sequences associated with or at a target locus of interest, the method comprising delivering to said locus a non-naturally occurring or engineered composition comprising a Group 29 or Group 30 effector protein and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA or consists of RNA.

The invention provides a method of modifying sequences associated with or at a target locus of interest, the method comprising delivering to said locus a non-naturally occurring or engineered composition comprising a Cas13b effector protein, optionally a small accessory protein, and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA or consists of RNA.

It will be appreciated that the terms Cas enzyme, CRISPR enzyme, CRISPR protein, Cas protein, and CRISPR Cas are generally used interchangeably and at all points of reference herein refer by analogy to novel CRISPR effector proteins further described in this application, unless otherwise apparent, such as by specific reference to Cas9. The CRISPR effector proteins described herein are preferably Group 29 and Group 30 effector proteins.

The invention provides a method of modifying sequences associated with or at a target locus of interest, the method comprising delivering to said sequences associated with or at the locus a non-naturally occurring or engineered composition comprising a Group 29 loci effector protein and one or more nucleic acid components, wherein the Group 29 effector protein forms a complex with the one or more nucleic acid components and upon binding of the said complex to the locus of interest the effector protein induces the modification of sequences associated with or at the target locus of interest. In a preferred embodiment, the modification is the introduction of a strand break. In a preferred embodiment the Group 29 or Group 30 effector protein forms a complex with one nucleic acid component; advantageously an engineered or non-naturally occurring nucleic acid component. The induction of modification of sequences associated with or at the target locus of interest can be Group 29 or Group 30 effector protein-nucleic acid guided. In a preferred embodiment the one nucleic acid component is a CRISPR RNA (crRNA). In a preferred embodiment the one nucleic acid component is a mature crRNA or guide RNA, wherein the mature crRNA or guide RNA comprises a spacer sequence (or guide sequence) and a direct repeat (DR) sequence or derivatives thereof. In a preferred embodiment the spacer sequence or the derivative thereof comprises a seed sequence, wherein the seed sequence is critical for recognition and/or hybridization to the sequence at the target locus. In a preferred embodiment of the invention the crRNA is a short crRNA that may be associated with a short DR sequence. In another embodiment of the invention the crRNA is a long crRNA that may be associated with a long DR sequence (or dual DR). Aspects of the invention relate to Group 29 or Group 30 effector protein complexes having one or more non-naturally occurring or engineered or modified or optimized nucleic acid components. In a preferred embodiment the nucleic acid component comprises RNA. In a preferred embodiment the nucleic acid component of the complex may comprise a guide sequence linked to a direct repeat sequence, wherein the direct repeat sequence comprises one or more stem loops or optimized secondary structures. In preferred embodiments of the invention, the direct repeat may be a short DR or a long DR (dual DR). In a preferred embodiment the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, υCb23r, 7s and PRR1. In a preferred embodiment the bacteriophage coat protein is MS2. The invention also provides for the nucleic acid component of the complex being 30 or more, 40 or more or 50 or more nucleotides in length.

The invention provides methods of genome editing or modifying sequences associated with or at a target locus of interest wherein the method comprises introducing a Group 29 or Group 30 effector protein or Group 29 or Group 30 effector protein complex into any desired cell type, prokaryotic or eukaryotic cell, whereby the Group 29 or Group 30 effector protein or Group 29 or Group 30 effector protein complex effectively functions to interfere with RNA in the eukaryotic or prokaryotic cell. In preferred embodiments, the cell is a eukaryotic cell and the RNA is transcribed from a mammalian genome or is present in a mammalian cell. In preferred methods of RNA editing or genome editing in human cells, the Group 29 or Group 30 effector proteins may include but are not limited to the specific species of Group 29 or Group 30 effector proteins disclosed herein.

The invention also provides a method of modifying a target locus of interest, the method comprising delivering to said locus a non-naturally occurring or engineered composition comprising a Group 29 or Group 30 effector protein and one or more nucleic acid components, wherein the Group 29 or Group 30 effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within a RNA molecule. In such methods the target locus of interest may be comprised in a RNA molecule in vitro.

In such methods the target locus of interest may be comprised in a RNA molecule within a cell. The cell may be a prokaryotic cell or a eukaryotic cell. The cell may be a mammalian cell. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The mammalian cell many be a non-human mammal, e.g., primate, bovine, ovine, porcine, canine, rodent, Leporidae such as monkey, cow, sheep, pig, dog, rabbit, rat or mouse cell. The cell may be a non-mammalian eukaryotic cell such as poultry bird (e.g., chicken), vertebrate fish (e.g., salmon) or shellfish (e.g., oyster, claim, lobster, shrimp) cell. The cell may also be a plant cell. The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc).

The invention provides a method of modifying a target locus of interest, the method comprising delivering to said locus a non-naturally occurring or engineered composition comprising a Group 29 or Group 30 effector protein and one or more nucleic acid components, wherein the effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within an RNA molecule. In a preferred embodiment, the target locus of interest comprises or consists of RNA.

The invention also provides a method of modifying a target locus of interest, the method comprising delivering to said locus a non-naturally occurring or engineered composition comprising a Group 29 or Group 30 effector protein and one or more nucleic acid components, wherein the Group 29 or Group 30 effector protein forms a complex with the one or more nucleic acid components and upon binding of the said complex to the locus of interest the effector protein induces the modification of the target locus of interest. In a preferred embodiment, the modification is the introduction of a strand break.

Preferably, in such methods the target locus of interest may be comprised in a RNA molecule in vitro. Also preferably, in such methods the target locus of interest may be comprised in a RNA molecule within a cell. The cell may be a prokaryotic cell or a eukaryotic cell. The cell may be a mammalian cell. The cell may be a rodent cell. The cell may be a mouse cell.

In any of the described methods the target locus of interest may be a genomic or epigenomic locus of interest. In any of the described methods the complex may be delivered with multiple guides for multiplexed use. In any of the described methods more than one protein(s) may be used.

In further aspects of the invention the nucleic acid components may comprise a CRISPR RNA (crRNA) sequence and/or a trans-activating crRNA (tracr RNA) sequence. In certain embodiments, cleavage such as biochemical or in vitro cleavage or cleavage in cells, can result without a transactivating crRNA (tracr RNA) sequence. In other embodiments, cleavage such as biochemical or in vitro cleavage or cleavage in cells, can result with a transactivating crRNA (tracr RNA) sequence.

In further aspects of the invention the nucleic acid components may comprise a CRISPR RNA (crRNA) sequence and not comprise any trans-activating crRNA (tracr RNA) sequence. Without limitation, the Applicants hypothesize that in such instances, the pre-crRNA may comprise secondary structure that is sufficient for processing to yield the mature crRNA as well as crRNA loading onto the effector protein. By means of example and not limitation, such secondary structure may comprise, consist essentially of or consist of one or more stem loop within the pre-crRNA, more particularly within the direct repeat.

In certain embodiments, where the effector protein is a Group 29 or Group 30 effector protein, the nucleic acid components may comprise a CRISPR RNA (crRNA) sequence and may not comprise any trans-activating crRNA (tracr RNA) sequence.

In any of the described methods the effector protein and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. In any of the described methods the target locus of interest may be a genomic, epigenomic, or transcriptomic locus of interest. In any of the described methods the complex may be delivered with multiple guides for multiplexed use. In any of the described methods more than one protein(s) may be used.

In any of the described methods the strand break may be a single strand break or a double strand break. In preferred embodiments the double strand break may refer to the breakage of two sections of RNA, such as the two sections of RNA formed when a single strand RNA molecule has folded onto itself or putative double helices that are formed with an RNA molecule which contains self-complementary sequences allows parts of the RNA to fold and pair with itself.

Regulatory elements may comprise inducible promotors. Polynucleotides and/or vector systems may comprise inducible systems.

In any of the described methods the one or more polynucleotide molecules may be comprised in a delivery system, or the one or more vectors may be comprised in a delivery system.

In any of the described methods the non-naturally occurring or engineered composition may be delivered via liposomes, particles including particles, exosomes, microvesicles, a gene-gun or one or more viral vectors.

The invention also provides a non-naturally occurring or engineered composition which is a composition having the characteristics as discussed herein or defined in any of the herein described methods.

In certain embodiments, the invention thus provides a non-naturally occurring or engineered composition, such as particularly a composition capable of or configured to modify a target locus of interest, said composition comprising a Group 29 or Group 30 effector protein and one or more nucleic acid components, wherein the effector protein forms a complex with the one or more nucleic acid components and upon binding of the said complex to the locus of interest the effector protein induces the modification of the target locus of interest. In certain embodiments, the effector protein may be a Group 29 effector protein.

The invention also provides in a further aspect a non-naturally occurring or engineered composition, such as particularly a composition capable of or configured to modify a target locus of interest, said composition comprising: (a) a guide RNA molecule (or a combination of guide RNA molecules, e.g., a first guide RNA molecule and a second guide RNA molecule) or a nucleic acid encoding the guide RNA molecule (or one or more nucleic acids encoding the combination of guide RNA molecules); (b) a Group 29 or Group 30 effector protein. In certain embodiments, the effector protein may be a Group 29 effector protein.

The invention also provides in a further aspect a non-naturally occurring or engineered composition comprising: (I.) one or more CRISPR-Cas system polynucleotide sequences comprising (a) a guide sequence capable of hybridizing to a target sequence in a polynucleotide locus, (b) a tracr mate sequence, and (c) a tracrRNA sequence, and (II.) a second polynucleotide sequence encoding a Group 29 or Group 30 effector protein, wherein when transcribed, the tracr mate sequence hybridizes to the tracrRNA sequence and the guide sequence directs sequence-specific binding of a CRISPR complex to the target sequence, and wherein the CRISPR complex comprises the Group 29 or Group 30 effector protein complexed with (1) the guide sequence that is hybridized to the target sequence, and (2) the tracr mate sequence that is hybridized to the tracrRNA sequence. In certain embodiments, the effector protein may be a Group 29 effector protein.

In certain embodiments, a tracrRNA may not be required. Hence, the invention also provides in certain embodiments a non-naturally occurring or engineered composition comprising: (I.) one or more CRISPR-Cas system polynucleotide sequences comprising (a) a guide sequence capable of hybridizing to a target sequence in a polynucleotide locus, and (b) a direct repeat sequence, and (II.) a second polynucleotide sequence encoding a Group 29 or Group 30 effector protein, wherein when transcribed, the guide sequence directs sequence-specific binding of a CRISPR complex to the target sequence, and wherein the CRISPR complex comprises the Group 29 or Group 30 effector protein complexed with (1) the guide sequence that is hybridized to the target sequence, and (2) the direct repeat sequence. Preferably, the effector protein may be a Group 29 effector protein. Without limitation, the Applicants hypothesize that in such instances, the direct repeat sequence may comprise secondary structure that is sufficient for crRNA loading onto the effector protein. By means of example and not limitation, such secondary structure may comprise, consist essentially of or consist of a stem loop (such as one or more stem loops) within the direct repeat.

The invention also provides a vector system comprising one or more vectors, the one or more vectors comprising one or more polynucleotide molecules encoding components of a non-naturally occurring or engineered composition which is a composition having the characteristics as defined in any of the herein described methods.

The invention also provides a delivery system comprising one or more vectors or one or more polynucleotide molecules, the one or more vectors or polynucleotide molecules comprising one or more polynucleotide molecules encoding components of a non-naturally occurring or engineered composition which is a composition having the characteristics discussed herein or as defined in any of the herein described methods.

The invention also provides a non-naturally occurring or engineered composition, or one or more polynucleotides encoding components of said composition, or vector or delivery systems comprising one or more polynucleotides encoding components of said composition for use in a therapeutic method of treatment. The therapeutic method of treatment may comprise gene or genome editing, or gene therapy.

The invention also encompasses computational methods and algorithms to predict new Cas protein agnostic single effector protein CRIPSR systems and identify the components therein.

The invention also provides for methods and compositions wherein one or more amino acid residues of the effector protein may be modified e.g., an engineered or non-naturally-occurring Group 20 or Group 30 effector protein. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of one RNA strand at the target locus of interest. In a preferred embodiment, the one or more mutations may comprise two mutations. In a preferred embodiment the one or more amino acid residues are modified in a Group 29 or Group 30 effector protein, e.g., an engineered or non-naturally-occurring Group 29 or Group 30 effector protein. In cetain embodiments of the invention the effector protein comprises one or more HEPN domains. In a preferred embodiment, the effector protein comprises two HEPN domains. In another preferred embodiment, the effector protein comprises one HEPN domain at the C-terminus and another HEPN domain at the N-terminus of the protein. In certain embodiments, the one or more mutations or the two or more mutations may be in a catalytically active domain of the effector protein comprising a HEPN domain, or a catalytically active domain which is homologous to a HEPN domain. In certain embodiments, the effector protein comprises one or more of the following mutations: R116A, H121A, R1177A, H1182A (wherein amino acid positions correspond to amino acid positions of Group 29 protein originating from *Bergeyella zoohelcum* ATCC 43767), such as R116A, H121A, R1177A, and H1182A; R116A, H121A, and R1177A; R116A, H121A, and H1182A; R116A, R1177A, and H1182A; H121A, R1177A, and H1182A; R116A and H121A; R116A and R1177A; R116A and H1182A; H121A and R1177A; H121A and H1182A; R1177A and H1182A; R116A; H121A; R1177A; H1182A. The skilled person will understand that corresponding amino acid positions in different Group 29 or Group 30 proteins may be mutated to the same effect. In certain embodiments, one or more of mutations R116A, H121A, R1177A, H1182A abolish catalytic activity of the protein completely or partially (e.g. altered cleavage rate, altered specificity, etc.), such as R116A, H121A, R1177A, and H1182A; R116A, H121A, and R1177A; R116A, H121A, and H1182A; R116A, R1177A, and H1182A; H121A, R1177A, and H1182A; R116A and H121A; R116A and R1177A; R116A and H1182A; H121A and R1177A; H121A and H1182A; R1177A and H1182A; R116A; H121A; R1177A; H1182A. In certain embodiments, the effector protein as described herein is a "dead" effector protein, such as a deas Group 29 or dead Group 30 effector protein (i.e. dGroup 29 or dGroup 30). In certain embodiments, the effector protein has one or more mutations in HEPN domain 1. In certain embodiments, the effector protein has one or more mutations in HEPN domain 2. In certain embodiments, the effector protein has one or more mutations in HEPN domain 1 and HEPN domain 2. The effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the effector protein (e.g., Group 29 or Group 30 effector protein) and if two or more NLSs, each of the two may be positioned at or near or in proximity to a terminus of the effector protein (e.g., Group 29 or Group 30 effector protein). The one or more heterologous functional domains may comprise one or more transcriptional activation domains. In a preferred embodiment the transcriptional activation domain may comprise VP64. The one or more heterologous functional domains may comprise one or more transcriptional repression domains. In a preferred embodiment the transcriptional repression domain comprises a KRAB domain or a SID domain (e.g. SID4X). The one or more heterologous functional domains may comprise one or more nuclease domains. In a preferred embodiment a nuclease domain comprises Fok1.

The invention also provides for the one or more heterologous functional domains to have one or more of the following activities: methylase activity, demethylase activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

The invention also provides for the effector protein comprising an effector protein from an organism from a genus comprising Bergeyella, *Prevotella, Porphyromonas, Bacteroides, Alistipes, Riemerella, Myroides, Flavobacterium, Capnocytophaga, Chryseobacterium*, Phaeodactylibacter, Paludibacter or *Psychroflexus*. In a preferred embodiment the Group 29 or Group 30 effector protein may be from a group which includes but is not limited to the following organisms: *Bergeyella zoohelcum, Prevotella intermedia, Prevotella buccae, Porphyromonas gingivalis, Bacteroides pyogenes, Alistipes* sp., *Prevotella* sp. MA2016, *Riemerella anatipestifer, Prevotella aurantiaca, Prevotella saccharo-lytica, Myroides odoratimimus, Flavobacterium columnare, Flavobacterium branchiophilum, Bacteroides pyogenes, Bacteroides coprosuis, Capnocytophaga canimorsus, Capnocytophaga cynodegmi, Chryseobacterium* sp., *Paludibacter propionicigenes*, Phaeodactylibacter *xiamenensis, Porphyromonas gingivalis, Porphyromonas gulae, Prevotella falsenii, Prevotella intermedia, Prevotella pallens, Prevotella pleuritidis, Prevotella saccharolytica, Prevotella* sp. P5-119 and *Psychroflexus torquis*.

The effector protein may comprise a chimeric effector protein comprising a first fragment from a first effector protein ortholog and a second fragment from a second effector protein ortholog, and wherein the first and second effector protein orthologs are different. At least one of the first and second effector protein orthologs may comprise an effector protein from an organism comprising Bergeyella, Prevotella, Porphyromonas, Bacteroides, Alistipes, Riemerella, Myroides, Flavobacterium, Capnocytophaga, Chryseobacterium, Paludibacter, Phaeodactylibacter or Psychroflexus.

In certain embodiments, the effector protein, particularly a Group 29 or Group 30 effector protein effector protein may be at least 700 amino acids long. In preferred embodiments, the effector protein may be about 1100 to about 1500 amino acids long, e.g., about 1100 to about 1200 amino acids long, or about 1200 to about 1300 amino acids long, or about 1300 to about 1400 amino acids long, or about 1400 to about 1500 amino acids long, e.g., about 900, about 1000, about 1100, about 1200, about 1300, about 1400, about 1500, about 1600, about 1700, or about 1800 amino acids long.

In certain embodiments, the Group 29 or Group 30 effector proteins as intended herein may be associated with a locus comprising short CRISPR repeats between 30 and 40 bp long, more typically between 34 and 38 bp long, even more typically between 36 and 37 bp long, e.g., 30, 31, 32, 33, 34, 35, 36, 37, 38, 39, or 40 bp long. In certain embodiments the CRISPR repeats are long or dual repeats between 80 and 350 bp long such as between 80 and 200 bp long, even more typically between 86 and 88 bp long, e.g., 80, 81, 82, 83, 84, 85, 86, 87, 88, 89, or 90 bp long In certain embodiments, a protospacer adjacent motif (PAM) or PAM-like motif directs binding of the effector protein (e.g. a Group 29 or Group 30 effector protein) complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). In other embodiments, both a 5' PAM and a 3' PAM are required. In certain embodiments of the invention, a PAM or PAM-like motif may not be required for directing binding of the effector protein (e.g. a Group 29 or Group 30 effector protein). In certain embodiments, a 5' PAM is D (i.e. A, G, or U). In certain embodiments, a 5' PAM is D for Group 29 effectors. In certain embodiments, a 5' PAM is D for Group 29 effectors originating from *Bergeyella zoohelcum* (such as *Bergeyella zoohelcum* ATCC 43767) In certain embodiments of the invention, cleavage at repeat sequences may generate crRNAs (e.g. short or long crRNAs) containing a full spacer sequence flanked by a short nucleotide (e.g. 5, 6, 7, 8, 9, or 10 nt or longer if it is a dual repeat) repeat sequence at the 5' end (this may be referred to as a crRNA "tag") and the rest of the repeat at the 3'end. In certain embodiments, targeting by the effector proteins described herein may require the lack of homology between the crRNA tag and the target 5' flanking sequence. This requirement may be similar to that described further in Samai et al. "Co-transcriptional DNA and RNA Cleavage during Type III CRISPR-Cas Immunity" Cell 161, 1164-1174, May 21, 2015, where the requirement is thought to distinguish between bona fide targets on invading nucleic acids from the CRISPR array itself, and where the presence of repeat sequences will lead to full homology with the crRNA tag and prevent autoimmunity.

In certain embodiments, the Group 29 or Group 30 effector protein is engineered and can comprise one or more mutations that reduce or eliminate nuclease activity, thereby reducing or eliminating RNA interfering activity. Mutations can also be made at neighboring residues, e.g., at amino acids near those that participate in the nuclease activity. In some embodiments, one or more putative catalytic nuclease domains are inactivated and the effector protein complex lacks cleavage activity and functions as an RNA binding complex. In a preferred embodiment, the resulting RNA binding complex may be linked with one or more functional domains as described herein.

In certain embodiments, the one or more functional domains are controllable, i.e. inducible.

In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In preferred embodiments of the invention, the mature crRNA comprises a stem loop or an optimized stem loop structure or an optimized secondary structure. In preferred embodiments the mature crRNA comprises a stem loop or an optimized stem loop structure in the direct repeat sequence, wherein the stem loop or optimized stem loop structure is important for cleavage activity. In certain embodiments, the mature crRNA preferably comprises a single stem loop. In certain embodiments, the direct repeat sequence preferably comprises a single stem loop. In certain embodiments, the cleavage activity of the effector protein complex is modified by introducing mutations that affect the stem loop RNA duplex structure. In preferred embodiments, mutations which maintain the RNA duplex of the stem loop may be introduced, whereby the cleavage activity of the effector protein complex is maintained. In other preferred embodiments, mutations which disrupt the RNA duplex structure of the stem loop may be introduced, whereby the cleavage activity of the effector protein complex is completely abolished.

The invention also provides for the nucleotide sequence encoding the effector protein being codon optimized for expression in a eukaryote or eukaryotic cell in any of the herein described methods or compositions. In an embodiment of the invention, the codon optimized effector protein is any Group 29 or Group 30 effector protein discussed herein and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In certain embodiments of the invention, at least one nuclear localization signal (NLS) is attached to the nucleic acid sequences encoding the Group 29 or Group 30 Group 29 or Group 30 effector proteins. In preferred embodiments at least one or more C-terminal or N-terminal NLSs are attached (and hence nucleic acid molecule(s) coding for the Group 29 or Group 30 effector protein can include coding for NLS(s) so that the expressed product has the NLS(s) attached or connected). In a preferred embodiment a C-terminal NLS is attached for optimal expression and nuclear targeting in eukaryotic cells, preferably human cells. The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

In a further aspect, the invention provides a eukaryotic cell comprising a modified target locus of interest, wherein the target locus of interest has been modified according to in any of the herein described methods. A further aspect provides a cell line of said cell. Another aspect provides a multicellular organism comprising one or more said cells.

In certain embodiments, the modification of the target locus of interest may result in: the eukaryotic cell comprising altered expression of at least one gene product; the eukaryotic cell comprising altered expression of at least one gene product, wherein the expression of the at least one gene product is increased; the eukaryotic cell comprising altered expression of at least one gene product, wherein the expression of the at least one gene product is decreased; or the eukaryotic cell comprising an edited genome.

In certain embodiments, the eukaryotic cell may be a mammalian cell or a human cell.

In further embodiments, the non-naturally occurring or engineered compositions, the vector systems, or the delivery systems as described in the present specification may be used for: site-specific gene knockout; site-specific genome editing; RNA sequence-specific interference; or multiplexed genome engineering.

Also provided is a gene product from the cell, the cell line, or the organism as described herein. In certain embodiments, the amount of gene product expressed may be greater than or less than the amount of gene product from a cell that does not have altered expression or edited genome. In certain embodiments, the gene product may be altered in comparison with the gene product from a cell that does not have altered expression or edited genome.

In another aspect, the invention provides a method for identifying novel nucleic acid modifying effectors, comprising: identifying putative nucleic acid modifying loci from a set of nucleic acid sequences encoding the putative nucleic acid modifying enzyme loci that are within a defined distance from a conserved genomic element of the loci, that comprise at least one protein above a defined size limit, or both; grouping the identified putative nucleic acid modifying loci into subsets comprising homologous proteins; identifying a final set of candidate nucleic acid modifying loci by selecting nucleic acid modifying loci from one or more subsets based on one or more of the following; subsets comprising loci with putative effector proteins with low domain homology matches to known protein domains relative to loci in other subsets, subsets comprising putative proteins with minimal distances to the conserved genomic element relative to loci in other subsets, subsets with loci comprising large effector proteins having a same orientations as putative adjacent accessory proteins relative to large effector proteins in other subsets, subset comprising putative effector proteins with lower existing nucleic acid modifying classifications relative to other loci, subsets comprising loci with a lower proximity to known nucleic acid modifying loci relative to other subsets, and total number of candidate loci in each subset.

In one embodiment, the set of nucleic acid sequences is obtained from a genomic or metagenomic database, such as a genomic or metagenomic database comprising prokaryotic genomic or metagenomic sequences.

In one embodiment, the defined distance from the conserved genomic element is between 1 kb and 25 kb.

In one embodiment, the conserved genomic element comprises a repetitive element, such as a CRISPR array. In a specific embodiment, the defined distance from the conserved genomic element is within 10 kb of the CRISPR array.

In one embodiment, the defined size limit of a protein comprised within the putative nucleic acid modifying locus is greater than 200 amino acids, or more particularly, the defined size limit is greater than 700 amino acids.

In one embodiment, the conserved genomic elements are identified using a repeat or pattern finding analysis of the set of nucleic acids, such as PILER-CR.

In one embodiment, the grouping step of the method described herein is based, at least in part, on results of a domain homology search or an HHpred protein domain homology search.

In one embodiment, the defined threshold is a BLAST nearest-neighbor cut-off value of 0 to 1e-7.

In one embodiment, the method described herein further comprises a filtering step that includes only loci with putative proteins between 900 and 1800 amino acids.

In one embodiment, the method described herein further comprises experimental validation of the nucleic acid modifying function of the candidate nucleic acid modifying effectors comprising generating a set of nucleic acid constructs encoding the nucleic acid modifying effectors and performing one or more biochemical validation assays, such as through the use of PAM validation in bacterial colonies, in vitro cleavage assays, the Surveyor method, experiments in mammalian cells, PFS validation, or a combination thereof.

In one embodiment, the method described herein further comprises preparing a non-naturally occurring or engineered composition comprising one or more proteins from the identified nucleic acid modifying loci.

In one embodiment, the identified loci comprise a Class 2 CRISPR effector, or the identified loci lack Cas1 or Cas2, or the identified loci comprise a single effector.

In one embodiment, the single large effector protein is greater than 900, or greater than 1100 amino acids in length, or comprises at least one HEPN domain.

In one embodiment, the at least one HEPN domain is near a N- or C-terminus of the effector protein, or is located in an interior position of the effector protein.

In one embodiment, the single large effector protein comprises a HEPN domain at the N- and C-terminus and two HEPN domains internal to the protein.

In one embodiment, the identified loci further comprise one or two small putative accessory proteins within 2 kb to 10 kb of the CRISPR array.

In one embodiment, the small accessory protein comprises multiple predicted transmembrane domains, or comprises four predicted transmembrane domains, or comprises at least one HEPN domain.

In one embodiment, the small accessory protein comprises at least one HEPN domain and at least one transmembrane domain.

In one embodiment, the loci comprise no additional proteins out to 25 kb from the CRISPR array.

In one embodiment, the CRISPR array comprises direct repeat sequences comprising about 36 nucleotides in length. In a specific embodiment, the direct repeat comprises a GTTG/GUUG at the 5' end that is reverse complementary to a CAAC at the 3' end.

In one embodiment, the CRISPR array comprises spacer sequences comprising about 30 nucleotides in length.

In one embodiment, the identified loci lack a small accessory protein.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 2 provides preliminary counts of discovered arrays (all arrays and arrays with single large effectors >700 aa) and large proteins (900-1800 aa) in arrays.

FIGS. 5A-5E show a list of all currently known Group 29 proteins by protein accession, genome accession, species, and strain of bacteria.

Figure 6B:
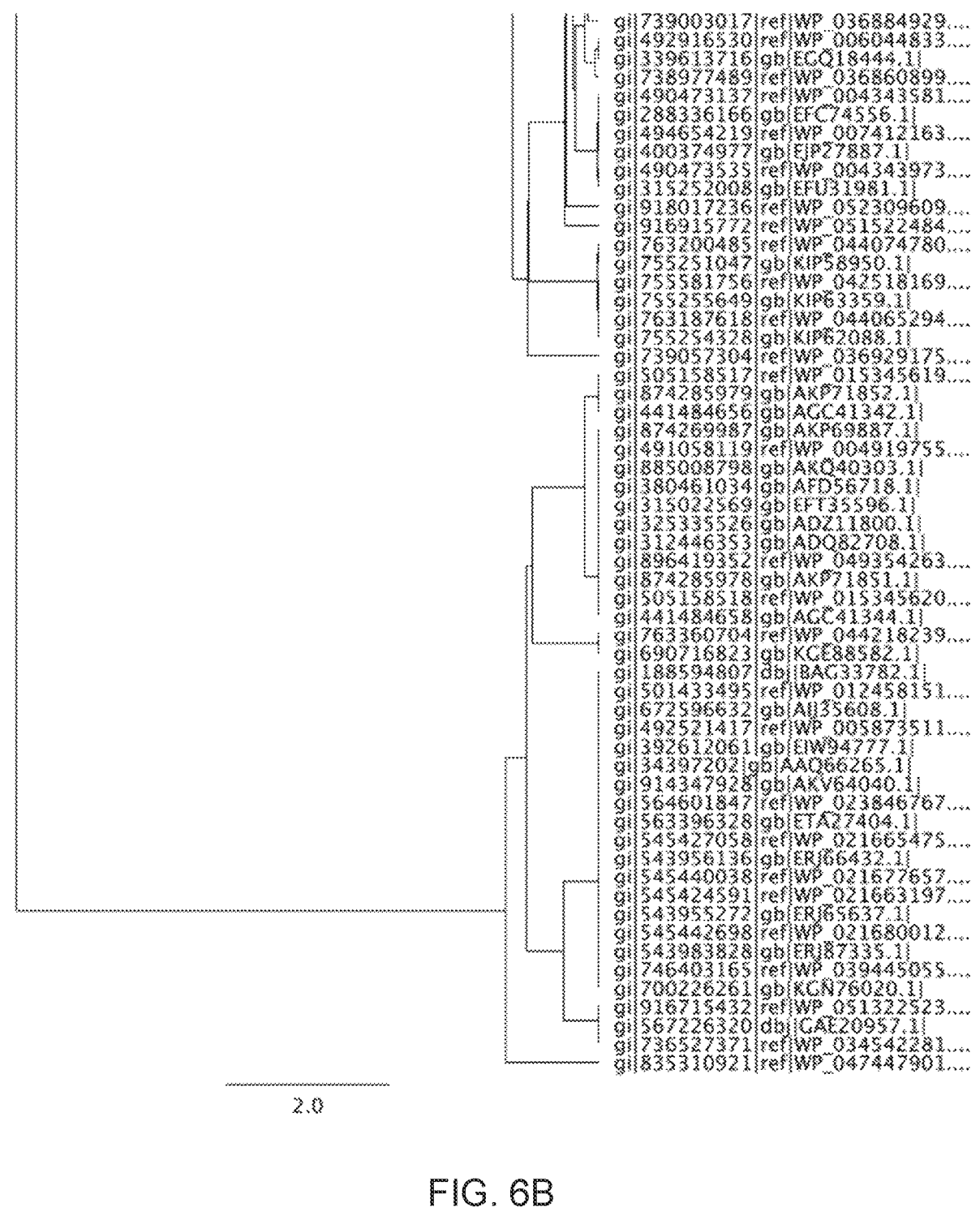

FIGS. 6A and 6B show a phylogenic tree of Group 29 proteins from FIGS. 5A-5E.

FIG. 7 shows a select subset of Group 29 chosen for uniqueness, derived from the listing in FIG. 5.

FIGS. 14A-14E show select unique Group 29 direct repeat sequences. (SEQ ID Nos. 640 through 697)

Figure 16B:
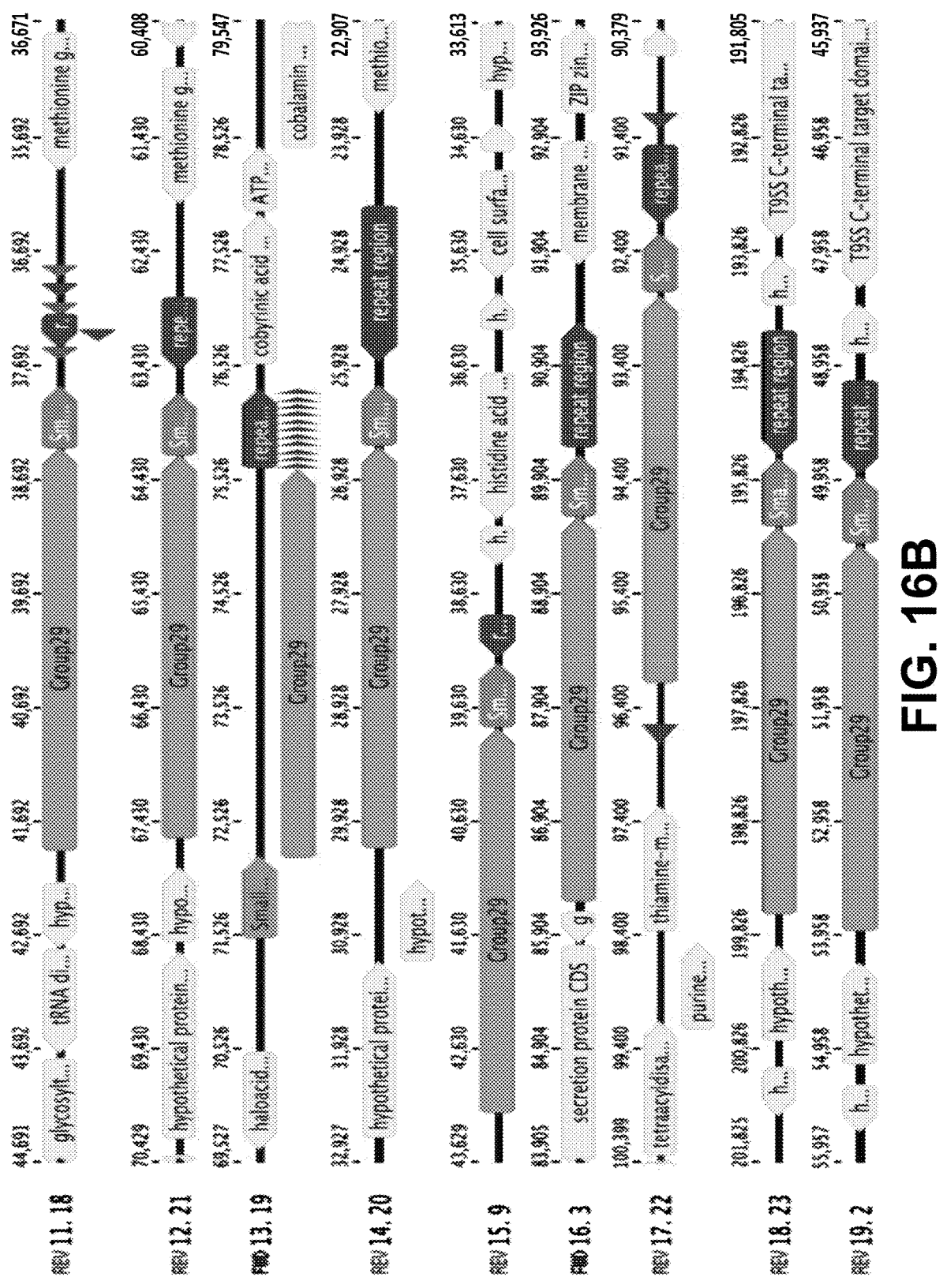

FIGS. 16A-16C show select unique Group 29 extracted genomic loci, depicting Group 29 protein, repeat region with CRISPR array, and at times accessory small protein.

Figure 18A:
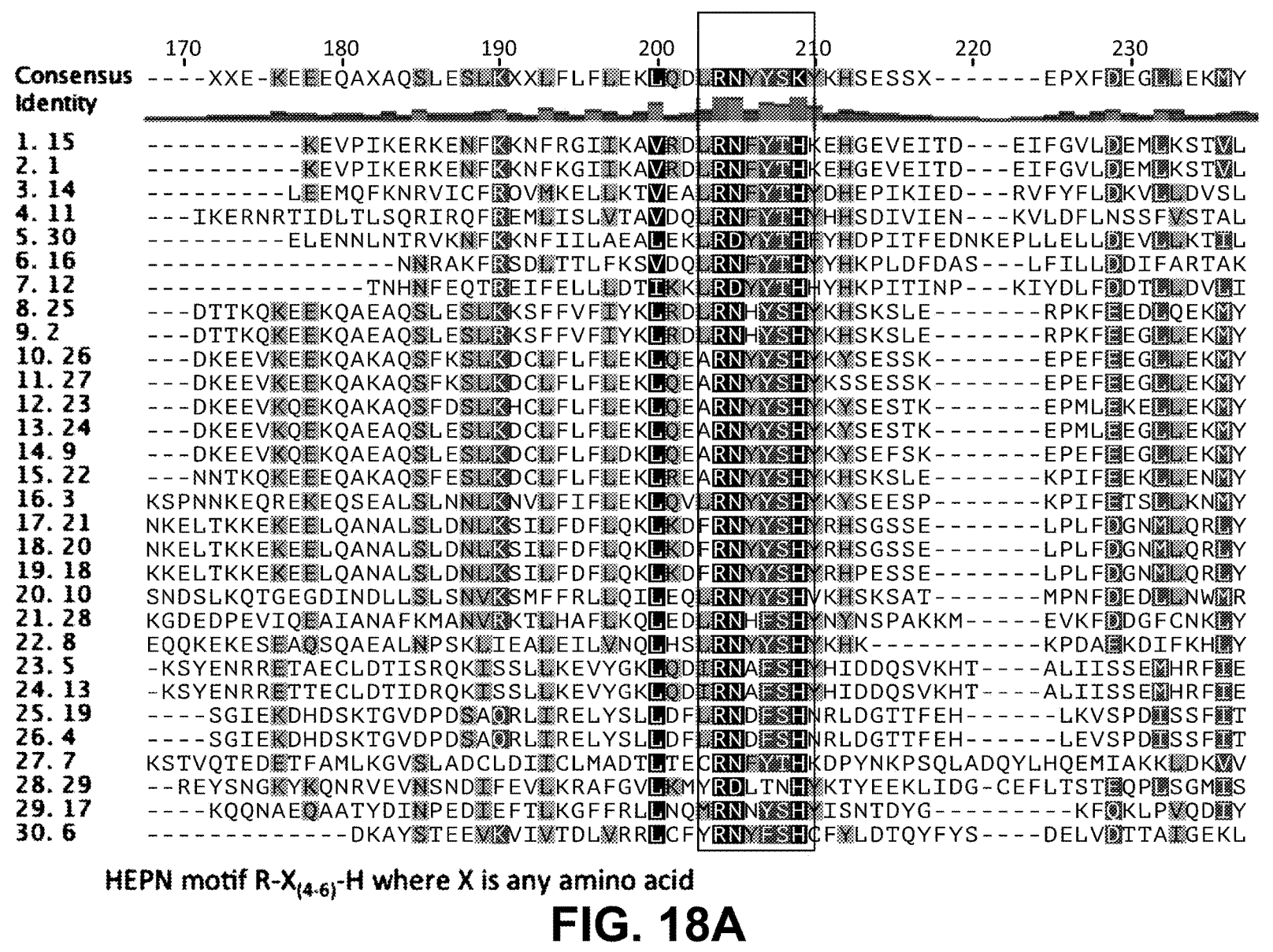

FIGS. 18A and 18B show the HEPN domains indicated at N terminus and C terminus of all Group 29 proteins. (SEQ ID Nos. 703 through 733)

FIG. 32 shows the Fb short DR. (SEQ ID No. 758)

Figure 34:
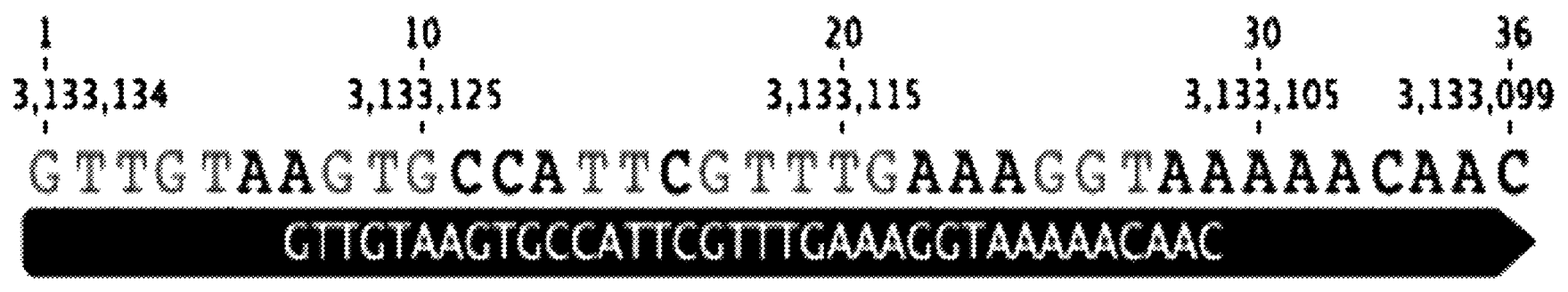

FIG. 34 shows the Pp short DR. (SEQ ID Nos. 758)

FIG. 35A: assay with E1-N2-01; guide. FIG. 35B: assay with E1-T2 guide.

FIG. 36B shows results of cleavage assay of an EGFP RNA target by Group 29 effector (from *Bergeyella zoohelcum* ATCC 43767). Wilt type ("WT") and dead ("d") Group 29 enzymes were evaluated with the indicated crRNAs. FIG. 36C shows results of binding assay of mutated Group 29 effector (from *Bergeyella zoohelcum* ATCC 43767) to EGFP target via EMSA at indicated effector protein/RNA ratios. (mutations: R1177A; H1182A). EGFP 1 target, 60 min incubation 50 mM NaCl, 1 mM DTT, Tris-HCl pH7.5, 0.1% BSA. FIG. 36D shows results of cleavage assay of an EGFP RNA target by mutated Group 29 effector (from *Bergeyella zoohelcum* ATCC 43767). Mutations: R1177A, H1182A. EGFP 1 target, 60 min incubation 50 mM NaCl, 1 mM DTT, Tris-HCl pH7.5, 0.1% BSA.

FIG. 38A: schematic representation of Group 29 locus (from *Bergeyella zoohelcum* ATCC 43767) and targets used. FIG. 38B: results of cleavage assay of the indicated targets.

FIG. 39 shows results of cleavage assays of EGFP RNA target 1 (top) and both target 1 and target 2 (bottom) by Group 29 effector (from *Bergeyella zoohelcum* ATCC 43767) with the different guides for the indicated targets.

FIG. 41 shows EGFP Target sequences (artificial sequences) (SEQ ID Nos. 759 and 760)

FIGS. 43A and 43B depict the loci of 3 known group 30 effector proteins; FIG. 43B depicts three types of group30 effector proteins.

FIGS. 45A and 45B provide crRNAs. The short and long crRNAs are natively processed by BzGrp29. The VCP loop crRNA can be engineered by inserting a viral coat protein (VCP, e.g., MS2, PP7) loop into the direct repeat. The simplest way is to replace the long DR insert in the long crRNA with the VCP. One could also shorten or extend the scaffolding up to the VCP loop, and add additional VCP loops to recruit more domains to the dGRP29. FIG. 45B provides a Grp29 SAM system. The Grp29 SAM system consists of dGrp29 fused to an effector domain(s) (for example at the C terminus), a VCP fused to additional effector domain(s), and the VCP loop crRNA. The three components synergistically act to effect the substrate RNA.

FIG. 46A: Steps 1 through 5 of a bioinformatic pipeline to discover novel putative Class 2 CRISPR loci without Cas1 or Cas2. FIG. 46B: Abbreviated phylogenetic tree of type VI-B loci. Loci with cas13b (blue) and csx27 (brown) comprise type VI-B1; loci with cas13b (blue) and csx28 (gold) comprise VI-B2. FIG. 46C: HEPN domains in Cas13b and Csx28 from multiple sequence alignments. Top, two HEPN sequences identified via multiple sequence alignment (BLOSUM62) of putative non-redundant Cas13b proteins. Bottom, divergent HEPN sequence identified via multiple sequence alignment (BLOSUM62) of putative non-redundant Csx28 (also refered to as Cas13b-s2) proteins.

FIGS. 64A-64G show heterologous expression of *B. zoohelcum* VI-B locus mediates knockdown of *E. coli* essential genes. FIG. 64A: Design of *E. coli* essential gene screen to determine targeting rules of nucleic acid interference. FIG. 64B: Manhattan plots of mean spacer depletions mapped over 45 genes and aggregated across normalized gene distance for full *B. zoohelcum* VI-B1 locus (left) and cas13b (right), with non-targeting spacers in gray, safely depleted spacers (>5σ above mean depletion of non-targeting spacers) above blue line, and strongly depleted spacers (top 1% depleted) above red line. We performed three independent bioreplicates of each condition of the screen and quality-control-filtered the mean depletions of spacers by both a maximum coefficient of variation of 0.2 and a minimum abundance in the control screen of ⅓N, where N=55,700. This step reduced the total number of spacers included in the analysis to N'=~35,000-40,000, depending on the screen. FIG. 64C: Weblogo of sequence motifs of strongly depleted *B. zoohelcum* spacers. FIG. 64D: Normalized PFS score matrix, where each score is the ratio of number of safely depleted *B. zoohelcum* spacers to total number of spacers for a given PFS, scaled so that maximum PFS score is 1. FIG. 64E: Spacers targeting kanamycin to validate PFS targeting rules of 5' PFS (D) and 3'PFS (N followed by AN or NA). FIG. 64F: Results of kanamycin validation screen for *B. zoohelcum* cas13b in *E. coli*. FIG. 64G: Spacer abundances versus control for individual *B. zoohelcum* spacers, with abundances colored by type of spacer.

FIG. 65A: Protospacer design for MS2 phage plaque drop assay to test RNA interference. (SEQ ID Nos. 767 through 772) FIG. 65B: Plaque drop assay for full *B. zoohelcum* VI-B1 locus (left) and bzcas13b (right) FIG. 65C: DNA interference assay schematic and results. A target sequence is placed in frame at the start of the transcribed bla gene that confers ampicillin resistance or in a non-transcribed region of the same target plasmid. Target plasmids were co-transformed with bzcas13b plasmid or empty vectors conferring chloramphenicol resistance and plated on double selection antibiotic plates. FIG. 65D: Quantification of MS2 phage plaque drop assay with *B. zoohelcum* Cas13b HEPN mutants.

FIG. 66A: Methodology of secondary structure-mediated spacer efficiency analysis of *E. coli* essential gene screen data with Vienna RNAplfold. FIG. 66B: Optimization of top 1 accuracy (computationally predicted best spacer matches the experimentally top depleted spacer) and top 3 accuracy (computationally predicted top spacer falls in top 3 depleted depleted spacers) on randomly selected *B. zoohelcum* training dataset using RNAplfold, first with u start and u end, and then with W and L. FIG. 66C: Performance of optimized RNAplfold model on randomly selected *B. zoohelcum* testing dataset (48 cohorts for full *B. zoohelcum* VI-B1 locus, 56 cohorts for bzcas13b) against $10^6$ Monte Carlo simulations: empirical P-values from left to right of 3e-6, 1e-6, 8.7e-3, 6e-6. FIG. 66D: Empirical cumulative distribution function of safely depleted *B. zoohelcum* spacers over all genes from 5' UTR into gene and from 3' UTR into gene. Yellow line separates UTR and gene, red line is theoretical cumulative distribution function of uniformly distributed spacers, and blue line is empirical cumulative distribution of safely depleted *B. zoohelcum* spacers.

FIGS. 67A-67E demonstrate Class 2 type VI-B systems differentially modulated by Csx27 and Csx28. FIG. 67A: Normalized PFS matrix, for *P. buccae* VI-B2 locus. FIG. 67B: MS2 Plaque drop assay for full *P. buccae* VI-B2 locus (left) and pbcas13b (right). FIG. 67C: Spacer depletions of bzcas13b with and without bzcsx27 (brown), as compared to pbcas13b with and without pbcsx28 (gold). FIG. 67D: A sequence, structure, and spatial RNA targeting model for Cas13b. (On our website is a downloadable bzcas13b target design script with instructions for researchers, as well as a protocol for performing the *E. coli* essential gene screen on another CRISPR system.) FIG. 67E: A bimodal functional model for the VI-B system, with Csx27 repressing and Csx28 enhancing Cas13b-mediated RNA interference.

FIG. 68 shows phylogenetic tree of Cas13b bifurcated into two type VI-B CRISPR loci. A phylogenetic tree (alignment generated by BLOSUM62) of non-redundant Cas13b effectors, with the full type VI-B locus depicted in every instance. Accession numbers for genome, Cas13b (blue), and Csx27 (brown)/Csx28 (gold) are included, as well as number of nearby spacers detected by PILER-CR, the presence of other CRISPR-Cas elements in the genome, and the size of Cas13b are found in Table 1.

FIGS. 69A and 69B reveals that the predicted secondary structure of type VI-B direct repeats is well-conserved. FIG. 69A: Predicted secondary structure folds of structurally unique CRISPR class 2 type VI-B1 direct repeats (Vienna RNAfold). (SEQ ID NOs. 773 through 784) FIG. 69B: Predicted secondary structure folds of structurally unique CRISPR Class 2 type VI-B2 direct repeats. (SEQ ID Nos. 785 through 792)

FIGS. 70A and 70B show the well-conserved Type VI-B direct repeats; predicted protospacer flanking sequences are inconclusive. FIG. 70A: Weblogo of all unique VI-B direct repeat sequences of length 36nt, taken as the same transcriptional orientation as Cas13b. FIG. 70B: Weblogo of all unique VI-B protospacer flanking sequences from CRISPRTarget mapping of protospacers to phage and plasmid databases.

FIGS. 71A and 71B show Predicted transmembrane domains of Csx27 and Csx28 not validated experimentally. FIG. 71A: Transmembrane domain prediction in Csx27 of *B. zoohelcum* and Csx28 of *P. buccae* using TMHMM v2. FIG. 71B: N- and C-terminally fused RFP imaging of Csx27 of *B. zoohelcum* and Csx28 of *P. buccae.*

FIGS. 72A and 72B show agreement of second bioreplicate of kanamycin validation screen for Cas13b from *B. zoohelcum* to the first bioreplicate. FIG. 72A: Spacers targeting kanamycin to validate PFS targeting rules of 5' PFS (D) and 3'PFS (N followed by AN or NA). FIG. 72B: Spacer abundances versus control for individual *B. zoohelcum* spacers, with abundances colored by type of spacer.

FIG. 73 demonstrates bioreplicates of MS2 phage plaque drop assay. Plaque drop assay with bioreplicates for *B. zoohelcum* VI-B1 locus and cas13b, and for *P. buccae* VI-B2 locus and cas13b. (SEQ ID Nos. 793 through 798)

FIG. 74 demonstrates bioreplicates of HEPN mutant plaque drop assay. Plaque drop assay with bioreplicates for *B. zoohelcum* Cas13b HEPN mutants (R116A/H121A and R1177A/H1182A) versus wildtype Cas13b. (SEQ ID Nos. 799 and 800)

FIGS. 75A and 75B show *E. coli* essential gene screen of *P. buccae* VI-B2 CRISPR locus. FIG. 75A: Manhattan plots of spacer depletions mapped over 45 genes and aggregated across normalized gene distance for full *P. buccae* VI-B2 locus (left) and cas13b (right), with non-targeting spacers in gray, safely depleted (>5σ above mean depletion of non-targeting spacers) spacers above blue line, and strongly depleted (top 1% depleted) spacers above red line. FIG. 75B: Sequence weblogos of strongly depleted *P. buccae* spacers, revealing double-sided PFS (protospacer flanking sequence).

FIGS. 76A-76C shows computational analysis of secondary structure and spatial rules for *P. buccae* cas13b RNA targeting. FIG. 76A: Optimization of top 1 accuracy (computationally predicted spacer is top depleted) and top 3 accuracy (computationally predicted spacer falls in top 3 depleted) on randomly selected *P. buccae* training dataset using RNAplfold, first with u start and u end, and then with W and L. FIG. 76B: Performance of optimized RNAplfold model on randomly selected *P. buccae* testing dataset (41 cohorts for full *P. buccae* VI-B2 locus, 40 cohorts for pbcas13b) against $10^6$ Monte Carlo simulations: empirical P-values from left to right of 3.3e-2, 2.7e-3, 3.9e-3, 1.5e-5. FIG. 76C: Empirical cumulative distribution function of safely depleted *P. buccae* spacers over all genes from 5'UTR into gene and from 3' UTR into gene. Yellow line separates UTR and gene, red line is theoretical cumulative distribution function of uniformly distributed spacers, and blue line is empirical cumulative distribution of safely depleted *P. buccae* spacers.

FIG. 77 shows cleavage activity of target sequence by Cas13b with crRNAs having different spacer sequence lengths, ranging from 30 nucleotides or less. As shown, the spacer length of 27-30 nucleotides works for optimal cutting. At a spacer length of 26-22 nucleotides, the cutting is reduced, and at a length of 20 nucleotides or less, there was no cutting activity of the target sequence.

FIG. 78 is a schematic of a an example Type VI-B locus.

FIG. 79 is a schematic of an example large effector protein from a Type VI-B locus.

FIG. 80 is a graph showing the size distrubtion of putative large effector proteins identified in candidate Type VI-B locus.

FIG. 81 is an alignment of putative large effector proteins from candidate Type VI-B locus.

FIG. 82 is a schematic workflow from putative effector discovery to potential genomic engineering applications.

The figures herein are for illustrative purposes only and are not necessarily drawn to scale.

DETAILED DESCRIPTION OF THE INVENTION

Figure 1:
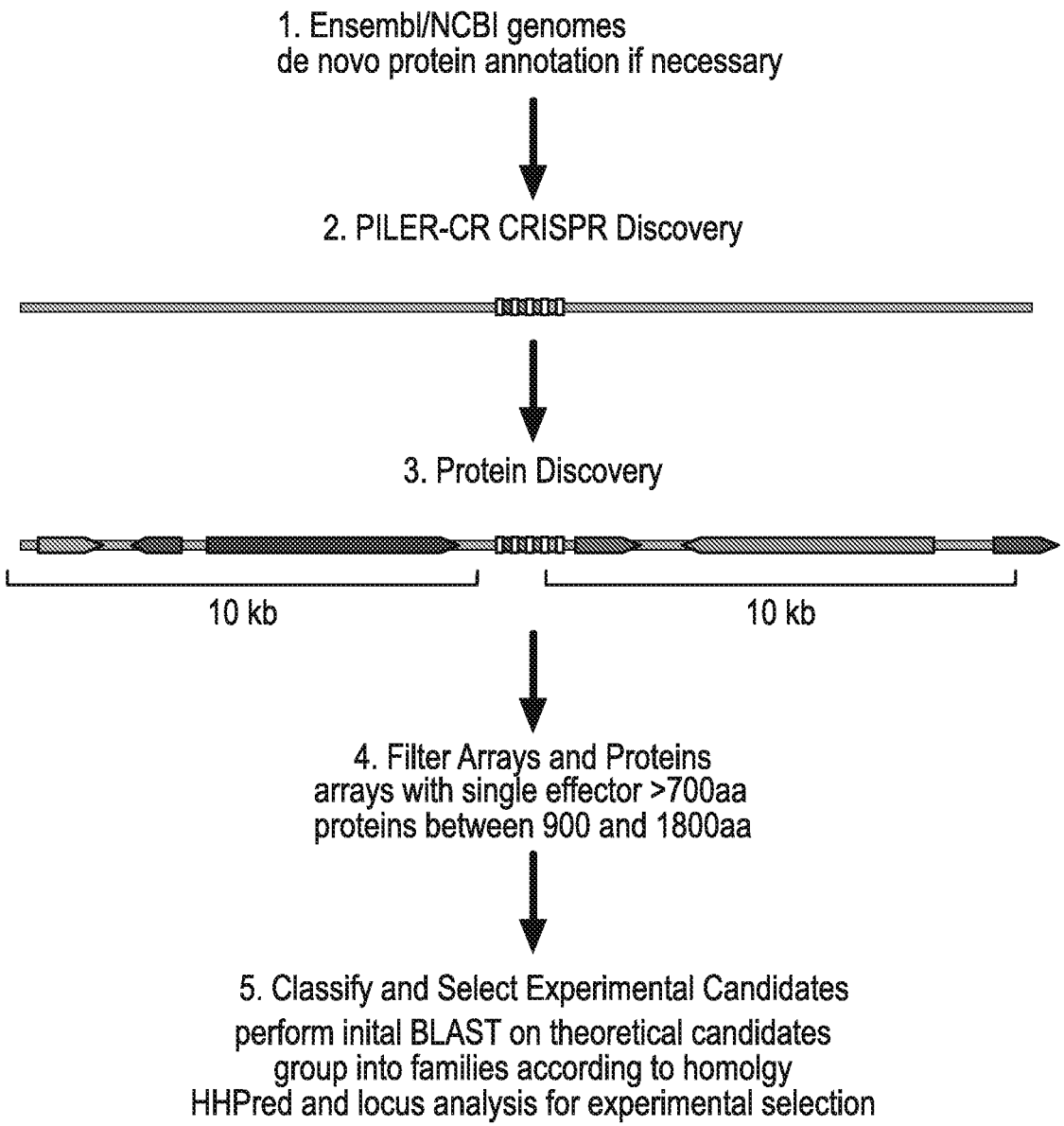
FIG. 1 shows the bioinformatic pipeline for new CRISPR single effector protein discovery.

In general, the CRISPR-Cas or CRISPR system refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system).

When the CRISPR protein is a Class 2 Type VI-B effector, a tracrRNA is not required. In an engineered system of the invention, the direct repeat may encompass naturally-occurring sequences or nonnaturally-occurring sequences. The direct repeat of the invention is not limited to naturally occurring lengths and sequences. A direct repeat can be 36nt in length, but a longer or shorter direct repeat can vary. For example, a direct repeat can be 30nt or longer, such as 30-100 nt or longer. For example, a direct repeat can be 30nt, 40nt, 50nt, 60nt, 70nt, 80nt, 90nt, 100nt, or longer in length. In some embodimenst, a direct repeat of the invention can include synthetic nucleotide sequences inserted between the 5' and 3' ends of naturally occuring direct repeat. In certain embodiments, the inserted sequence may be self-complementary, for example, 20%, 30%, 40%, 50%, 60%, 70%, 80%, 90%, or 100% self complementary. Furthermore, a direct repeat of the invention may include insertions of nucleotides such as an aptamer or sequences that bind to an adapter protein (for association with functional domains). In certain embodiments, one end of a direct repeat containing such an insertion is roughly the first half of a short DR and the other end is roughly the second half of the short DR.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise any polynucleotide, such as DNA or RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Type VI-B effector proteins, such as Cas13b and Group 29 or Group 30 proteins to a target locus, are used interchangeably as in foregoing cited documents such as WO 2014/093622 (PCT/US2013/074667). In general, a guide sequence (or spacer sequence) is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), Clustal W, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence (or spacer sequence) is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-40 nucleotides long, such as 20-30 or 20-40 nucleotides long or longer, such as 30 nucleotides long or about 30 nucleotides long. In certain embodiments, the guide sequence is 10-30 nucleotides long, such as 20-30 or 20-40 nucleotides long or longer, such as 30 nucleotides long or about 30 nucleotides long for Group 29 or Group 30 effectors. In certain embodiments, the guide sequence is 10-30 nucleotides long, such as 20-30 nucleotides long, such as 30 nucleotides long or about 30 nucleotides long for Group 29 effectors originating from *Bergeyella zoohelcum* (such as *Bergeyella zoohelcum* ATCC 43767). The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

The instant invention provides Type VI-B CRISPR-Cas effectors, nucleic acids, systems, vectors, and methods of use. Type VI-B CRISPR-Cas effectors and nucleic acids encompass both Group 29 and Group 30. All Group VI-B effectors are distinguishable from VI-A by structure, and also by the location of the HEPN domains). As used herein, the terms Cas13b-s1 accessory protein, Cas13b-s1 protein, Cas13b-s1, Csx27, and Csx27 protein are used interchangeably and the terms Cas13b-s2 accessory protein, Cas13b-s2 protein, Cas13b-S2, Csx28, and Csx28 protein are used interchangeably.

TABLE 1

Representative Type VI-B Effectors and Accessory Proteins

| Species (Genome Accession) | Cas13b Accession | Csx27/28 Accession | # Spacers | CRISPR-Cas? | Cas1? | Cas2? | Cas13b size (aa) |
|---|---|---|---|---|---|---|---|
| *Paludibacter propionicigenes* WB4 (NC_014734.1) | WP_013446107.1 | NA | 8 | N | N | N | 1155 |
| *Prevotella* sp. P5-60 (NZ_JXQJ01000080.1) | WP_044074780.1 | NA | 5 | Y | ? | ? | 1091 |
| *Prevotella* sp. P4-76 (NZ_JXQI01000021.1) | WP_044072147.1 | NA | 0 | ? | ? | ? | 1091 |
| *Prevotella* sp. P5-125 (NZ_JXQL01000055.1) | WP_044065294.1 | NA | 11 | ? | ? | ? | 1091 |
| *Prevotella* sp. P5-119 (NZ_JXQK01000043.1) | WP_042518169.1 | NA | 11 | ? | ? | ? | 1091 |
| *Capnocytophaga canimorsus* Cc5 (NC_015846.1) | WP_013997271.1 | WP_013997274.1 | 51 | Y | Y | Y | 1200 |
| *Phaeodactylibacter xiamenensis* (NZ_JPOS01000018.1) | WP_044218239.1 | WP_044218241.1 | 19 | ? | ? | ? | 1132 |
| *Porphyromonas gingivalis* W83 (NC_002950.2) | WP_005873511.1 | WP_005873518.1 | 7 | Y | Y | Y | 1136 |
| *Porphyromonas gingivalis* F0570 (NZ_KI259168.1) | WP_021665475.1 | WP_021665476.1 | 3 | ? | ? | ? | 1136 |
| *Porphyromonas gingivalis* ATCC 33277 (NC_010729.1) | WP_012458151.1 | WP_012458152.1 | 12 | Y | Y | Y | 1136 |
| *Porphyromonas gingivalis* F0185 (AWVC01000122.1) | ERJ81987.1 | ERJ81988.1 | 0 | ? | ? | ? | 1136 |
| *Porphyromonas gingivalis* F0185 (NZ_KI259960.1) | WP_021677657.1 | WP_021677658.1 | 6 | ? | ? | ? | 1136 |
| *Porphyromonas gingivalis* SJD2 (NZ_KI629875.1) | WP_023846767.1 | WP_005873518.1 | 4 | ? | ? | ? | 1136 |
| *Porphyromonas gingivalis* F0568 (AWUU01000145.1) | ERJ65637.1 | ERJ65638.1 | 3 | ? | ? | ? | 1136 |
| *Porphyromonas gingivalis* W4087 (AWVE01000130.1) | ERJ87335.1 | ERJ87336.1 | 2 | ? | ? | ? | 1136 |
| *Porphyromonas gingivalis* W4087 (NZ_KI260263.1) | WP_021680012.1 | WP_005873518.1 | 4 | ? | ? | ? | 1136 |
| *Porphyromonas gingivalis* F0568 (NZ_KI258981.1) | WP_021663197.1 | WP_021663198.1 | 6 | ? | ? | ? | 1136 |
| *Porphyromonas gingivalis* (NZ_LOEL01000010.1) | WP_061156637.1 | WP_005873518.1 | 11 | ? | ? | ? | 1136 |
| *Porphyromonas gulae* (NZ_JRAQ01000019.1) | WP_039445055.1 | WP_039445052.1 | 10 | ? | ? | ? | 1136 |
| *Bacteroides pyogenes* F0041 (KE993153.1) | ERI81700.1 | ERI81699.1 | 5 | ? | ? | ? | 1116 |
| *Bacteroides pyogenes* JCM 10003 (NZ_BAIU01000000 1.1) | WP_034542281.1 | WP_034542279.1 | 18 | ? | ? | ? | 1116 |
| *Alistipes* sp. ZOR0009 (NZ_JTLD01000029.1) | WP_047447901.1 | NA | 7 | ? | ? | ? | 954 |
| *Flavobacterium branchiophilum* FL-15 (NC_016001.1) | WP_014084666.1 | WP_014084665.1 | 19 | Y | N | Y | 1151 |
| *Prevotella* sp. MA2016 (NZ_JHUW01000010.1) | WP_036929175.1 | NA | 7 | ? | ? | ? | 1323 |
| *Myroides odoratimimus* CCUG 10230 (AGEC02000017.1) | EHO06562.1 | EHO06560.1 | 2 | ? | ? | ? | 1160 |
| *Myroides odoratimimus* CCUG 3837 (AGZK01000016.1) | EKB06014.1 | EKB06015.1 | 0 | ? | ? | ? | 1158 |
| *Myroides odoratimimus* CCUG 3837 (NZ_JH815535.1) | WP_006265509.1 | WP_006265510.1 | 0 | ? | ? | ? | 1158 |
| *Myroides odoratimimus* CCUG 12901 (NZ_JH590834.1) | WP_006261414.1 | WP_006261415.1 | 0 | ? | ? | ? | 1158 |
| *Myroides odoratimimus* CCUG 12901 (AGED01000033.1) | EHO08761.1 | EHO08762.1 | 0 | ? | ? | ? | 1158 |
| *Myroides odoratimimus* (NZ_CP013690.1) | WP_058700060.1 | WP_006261415.1 | 10 | Y | Y | Y | 1160 |
| *Bergeyella zoohelcum* ATCC 43767 (AGYA01000037.1) | EKB54193.1 | EKB54194.1 | 9 | ? | ? | ? | 1225 |
| *Capnocytophaga cynodegmi* (NZ_CDOD01000002.1) | WP_041989581.1 | WP_041989578.1 | 7 | ? | ? | ? | 1219 |
| *Bergeyella zoohelcum* ATCC 43767 (NZ_JH932293.1) | WP_002664492.1 | WP_034985946.1 | 8 | Y | Y | Y | 1225 |
| *Flavobacterium* sp. 316 (NZ_JYGZ01000003.1) | WP_045968377.1 | NA | 0 | ? | ? | ? | 1156 |
| *Psychroflexus torquis* ATCC 700755 (NC_018721.1) | WP_015024765.1 | NA | 16 | Y | Y | Y | 1146 |
| *Flavobacterium columnare* ATCC 49512 (NC_016510.2) | WP_014165541.1 | NA | 7 | Y | Y | Y | 1180 |
| *Flavobacterium columnare* (NZ_CP013992.1) | WP_060381855.1 | NA | 5 | Y | Y | Y | 1214 |

TABLE 1-continued

Representative Type VI-B Effectors and Accessory Proteins

| Species (Genome Accession) | Cas13b Accession | Csx27/28 Accession | # Spacers | CRISPR-Cas? | Cas1? | Cas2? | Cas13b size (aa) |
|---|---|---|---|---|---|---|---|
| *Flavobacterium columnare* (NZ_CP015107.1) | WP_063744070.1 | NA | 3 | Y | Y | Y | 1214 |
| *Flavobacterium columnare* (NZ_CP016277.1) | WP_065213424.1 | NA | 14 | Y | Y | Y | 1215 |
| *Chryseobacterium* sp. YR477 (NZ_KN549099.1) | WP_047431796.1 | NA | 0 | ? | ? | ? | 1146 |
| *Riemerella anatipestifer* ATCC 11845 = DSM 15868 (NC_014738.1) | WP_004919755.1 | WP_004919758.1 | 12 | Y | Y | Y | 1096 |
| *Riemerella anatipestifer* RA-CH-2 (NC_020125.1) | WP_015345620.1 | WP_004919758.1 | 12 | Y | Y | Y | 949 |
| *Riemerella anatipestifer* (NZ_CP007504.1) | WP_049354263.1 | WP_004919758.1 | 11 | Y | Y | Y | 949 |
| *Riemerella anatipestifer* (NZ_LUDU01000012.1) | WP_061710138.1 | WP_061710139.1 | 13 | ? | ? | ? | 951 |
| *Riemerella anatipestifer* (NZ_LUDI01000010.1) | WP_064970887.1 | WP_064970885.1 | 4 | ? | ? | ? | 1096 |
| *Prevotella saccharolytica* F0055 (AMEP01000091.1) | EKY00089.1 | EKY00090.1 | 0 | ? | ? | ? | 1151 |
| *Prevotella saccharolytica* JCM 17484 (NZ_BAKN01000001.1) | WP_051522484.1 | NA | 5 | Y | Y | Y | 1152 |
| *Prevotella buccae* ATCC 33574 (AEPD01000005.1) | EFU31981.1 | EFU31982.1 | 16 | ? | ? | ? | 1128 |
| *Prevotella buccae* ATCC 33574 (NZ_GL586311.1) | WP_004343973.1 | WP_004343974.1 | 16 | Y | Y | Y | 1128 |
| *Prevotella buccae* D17 (NZ_GG739967.1) | WP_004343581.1 | WP_004343582.1 | 8 | ? | ? | ? | 1128 |
| *Prevotella* sp. MSX73 (NZ_ALJQ01000043.1) | WP_007412163.1 | WP_036927782.1 | 13 | ? | ? | ? | 1128 |
| *Prevotella pallens* ATCC 700821 (AFPY01000052.1) | EGQ18444.1 | EGQ18443.1 | 4 | ? | ? | ? | 1126 |
| *Prevotella pallens* ATCC 700821 (NZ_GL982513.1) | WP_006044833.1 | WP_050795200.1 | 4 | ? | ? | ? | 1126 |
| *Prevotella intermedia* ATCC 25611 = DSM 20706 (NZ_JAEZ01000017.1) | WP_036860899.1 | WP_050795200.1 | 11 | ? | ? | ? | 1127 |
| *Prevotella intermedia* (NZ_LBGT01000010.1) | WP_061868553.1 | NA | 27 | ? | ? | ? | 1121 |
| *Prevotella intermedia* 17 (CP003502.1) | AFJ07523.1 | AFJ07898.1 | 16 | N | N | N | 1135 |
| *Prevotella intermedia* (NZ_AP014926.1) | WP_050955369.1 | WP_014708440.1 | 16 | N | N | N | 1133 |
| *Prevotella intermedia* (AP014598.1) | BAU18623.1 | BAU18624.1 | 6 | N | N | N | 1134 |
| *Prevotella intermedia* ZT (ATMK01000017.1) | KJJ86756.1 | KJJ86755.1 | 2 | ? | ? | ? | 1126 |
| *Prevotella aurantiaca* JCM 15754 (NZ_BAKF01000019.1) | WP_025000926.1 | WP_036889078.1 | 5 | ? | ? | ? | 1125 |
| *Prevotella pleuritidis* F0068 (NZ_AWET01000045.1) | WP_021584635.1 | WP_021584705.1 | 6 | ? | ? | ? | 1140 |
| *Prevotella pleuritidis* JCM 14110 (NZ_BAJN01000005.1) | WP_036931485.1 | WP_024991772.1 | 7 | ? | ? | ? | 1117 |
| *Prevotella falsenii* DSM 22864 = JCM 15124 (NZ_BAJY01000004.1) | WP_036884929.1 | WP_051527348.1 | 10 | ? | ? | ? | 1134 |
| *Porphyromonas gulae* (NZ_JRAT01000012.1) | WP_039418912.1 | WP_052073447.1 | 11 | Y | Y | Y | 1176 |
| *Porphyromonas* sp. COT-052 OH4946 (NZ_JQZY01000014.1) | WP_039428968.1 | WP_050563578.1 | 12 | ? | ? | ? | 1176 |
| *Porphyromonas gulae* (NZ_JRFD01000046.1) | WP_039442171.1 | WP_050563578.1 | 9 | ? | ? | ? | 1175 |
| *Porphyromonas gulae* (NZ_JRAJ01000010.1) | WP_039431778.1 | WP_046201041.1 | 2 | ? | ? | ? | 1176 |
| *Porphyromonas gulae* (NZ_KQ040500.1) | WP_046201018.1 | WP_046201041.1 | 4 | ? | ? | ? | 1176 |
| *Porphyromonas gulae* (NZ_JRAL01000022.1) | WP_039434803.1 | WP_039434800.1 | 20 | ? | ? | ? | 1176 |
| *Porphyromonas gulae* (NZ_JRAI01000002.1) | WP_039419792.1 | WP_052078041.1 | 9 | ? | ? | ? | 1120 |
| *Porphyromonas gulae* (NZ_JRAK01000129.1) | WP_039426176.1 | WP_039426172.1 | 6 | ? | ? | ? | 1120 |
| *Porphyromonas gulae* (NZ_KN294104.1) | WP_039437199.1 | WP_052102013.1 | 0 | ? | ? | ? | 1120 |

TABLE 1-continued

Representative Type VI-B Effectors and Accessory Proteins

| Species (Genome Accession) | Cas13b Accession | Csx27/28 Accession | # Spacers | CRISPR-Cas? | Cas1? | Cas2? | Cas13b size (aa) |
|---|---|---|---|---|---|---|---|
| *Porphyromonas gingivalis* TDC60 (NC_015571.1) | WP_013816155.1 | WP_043890185.1 | 2 | Y | Y | Y | 1120 |
| *Porphyromonas gingivalis* ATCC 33277 (NC_010729.1) | WP_012458414.1 | WP_012458413.1 | 4 | Y | Y | Y | 1120 |
| *Porphyromonas gingivalis* A7A1-28 (NZ_CP013131.1) | WP_058019250.1 | WP_043898408.1 | 6 | Y | Y | Y | 1176 |
| *Porphyromonas gingivalis* JCVI SC001 (APMB01000175.1) | EOA10535.1 | EOA10563.1 | 5 | ? | ? | ? | 1176 |
| *Porphyromonas gingivalis* W50 (NZ_AJZS01000051.1) | WP_005874195.1 | WP_010955981.1 | 2 | ? | ? | ? | 1176 |
| *Porphyromonas gingivalis* (NZ_CP011995.1) | WP_052912312.1 | WP_010955981.1 | 7 | Y | Y | Y | 1176 |
| *Porphyromonas gingivalis* AJW4 (NZ_CP011996.1) | WP_053444417.1 | WP_043898408.1 | 11 | N | N | N | 1120 |
| *Porphyromonas gingivalis* (NZ_CP007756.1) | WP_039417390.1 | WP_021665928.1 | 5 | Y | Y | Y | 1120 |
| *Porphyromonas gingivalis* (NZ_LOEL01000001.1) | WP_061156470.1 | WP_021663076.1 | 5 | ? | ? | ? | 1120 |

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and advantageously tracr RNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In particularly preferred embodiments according to the invention, the guide RNA (capable of guiding Cas to a target locus) may comprise (1) a guide sequence capable of hybridizing to a target locus (a polynucleotide target locus, such as an RNA target locus) in the eukaryotic cell; (2) a direct repeat (DR) sequence) which reside in a single RNA, i.e. an sgRNA (arranged in a 5' to 3' orientation). In particular embodiments, the CRISPR/Cas protein is characterized in that it makes use of a guide RNA comprising a guide sequence capable of hybridizing to a genomic target locus in the eukaryotic cell and a direct repeat sequence, and does not require a tracrRNA. In particular embodiments, where the CRISPR/Cas protein is characterized in that it makes use of a tracrRNA, the guide sequence, tracr mate and tracr sequence may reside in a single RNA, i.e. an sgRNA (arranged in a 5' to 3' orientation), or the tracr RNA may be a different RNA than the RNA containing the guide and tracr mate sequence. In these embodiments, the tracr hybridizes to the tracr mate sequence and directs the CRISPR/Cas complex to the target sequence.

As used herein, "database" refers to a repository of genomic sequence information. Non-limiting examples of include the NCBI database and the European Ensembl database.

As used herein, "CRISPR effector" or "effector" refers to an RNA-guided DNA-targeting polypeptide or an RNA-guided RNA-targeting polypeptide possessing enzymatic activity. Non-limiting examples of enzymatic activity include endonuclease, nickase, integrase, or transposase activity.

As used herein, "nuclease domain" refers to a protein domain capable of cleaving RNA, DNA, or both. "Cleaving" refers to the breaking of the covalent backbone of one or more strands of a target polynucleotide.

As used herein, the term "CRISPR array" refers to the DNA segment which includes all of the CRISPR repeats and spacers, starting with the first nucleotide of the first CRISPR repeat and ending with the last nucleotide of the last (terminal) CRISPR repeat. Typically, each spacer sequence in a CRISPR array is located between two repeats.

As used herein, the terms "CRISPR repeat," "direct repeat," "repeat sequence," or "repeat" have the conventional meaning as used in the art, i.e., multiple short direct repeating sequences, which show very little or no sequence variation within a given CRISPR array. As used herein, "CRISPR spacer," "spacer sequence," or "spacer" refer to the non-repetitive sequences that are located between the repeats of a CRISPR array.

A person of skill in art would use experimental techniques well known in the art to characterize an effector system identified by the method disclosed in the current invention.

For example, the components of a CRISPR system sufficient to form a CRISPR complex, including the CRISPR effector and RNA guide sequence to be tested, may be provided to a host cell having a corresponding target sequence, such as by transfection with vectors encoding the components of the CRISPR system, followed by an assessment of preferential cleavage within the target sequence, such as by Surveyor assay. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In particular embodiments, the wildtype group29/group30 effector protein has RNA binding and cleaving function.

In particular embodiments, the group29/group30 effector protein may have DNA cleaving function. In these embodiments, methods may be provided based on the effector proteins provided herein which comprehend inducing one or more mutations in a eukaryotic cell (in vitro, i.e. in an isolated eukaryotic cell) as herein discussed comprising delivering to cell a vector as herein discussed. The mutation (s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s) or sgRNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA (s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 40, 45, 50, 75, 100, 200, 300, 400 or 500 nucleotides at each target sequence of said cell(s) via the guide(s) RNA(s) or sgRNA(s).

For minimization of toxicity and off-target effect, it will be important to control the concentration of Cas mRNA and guide RNA delivered. Optimal concentrations of Cas mRNA and guide RNA can be determined by testing different concentrations in a cellular or non-human eukaryote animal model and using deep sequencing the analyze the extent of modification at potential off-target genomic loci. Alternatively, to minimize the level of toxicity and off-target effect, Cas nickase mRNA (for example S. pyogenes Cas9 with the D10A mutation) can be delivered with a pair of guide RNAs targeting a site of interest. Guide sequences and strategies to minimize toxicity and off-target effects can be as in WO 2014/093622 (PCT/US2013/074667); or, via mutation as herein.

Typically, in the context of an endogenous CRISPR system, formation of a CRISPR complex (comprising a guide sequence hybridized to a target sequence and complexed with one or more Cas proteins) results in cleavage of one or both strands (if applicable) in or near (e.g. within 1, 2, 3, 4, 5, 6, 7, 8, 9, 10, 20, 50, or more base pairs from) the target sequence. Without wishing to be bound by theory, the tracr sequence (if applicable or present), which may comprise or consist of all or a portion of a wild-type tracr sequence (e.g. about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to the guide sequence.

The nucleic acid molecule encoding a Cas is advantageously codon optimized Cas. An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a Cas is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way how the Cas transgene is introduced in the cell is may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or particle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus, such as for instance one or more oncogenic mutations, as for instance and without limitation described in Platt et al. (2014), Chen et al., (2014) or Kumar et al. (2009).

In some embodiments, the Cas sequence is fused to one or more nuclear localization sequences (NLSs), such as about or more than about 1, 2, 3, 4, 5, 6, 7, 8, 9, 10, or more NLSs. In some embodiments, the Cas comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the Cas comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV(SEQ ID NO: 1); the NLS from nucleoplasmin (e.g. the nucleoplasmin bipartite NLS with the sequence KRPAATKKAGQAKKKK) (SEQ ID NO: 2, artifical); the c-myc NLS having the amino acid sequence PAAKRVKLD (SEQ ID NO: 3, artifical) or RQRRNELKRSP (SEQ ID NO: 4, artifical); the hRNPA1 M9 NLS having the sequence NQSSNFGPMKGGNFGGRSSGPYGGGGQYFAK-PRNQGGY(SEQ ID NO: 5, artifical); the sequence RMRIZFKNKGKDTAELRRRRVEVSVELRKAKKD-EQILKRRNV (SEQ ID NO: 6, artifical) of the IBB domain from importin-alpha; the sequences VSRKRPRP (SEQ ID NO: 7, artifical) and PPKKARED (SEQ ID NO: 8, artifical) of the myoma T protein; the sequence PQPKKKPL (SEQ ID NO: 9) of human p53; the sequence SALIKKKKKMAP (SEQ ID NO: 10, mouse) of mouse c-abl IV; the sequences DRLRR (SEQ ID NO: 11) and PKQKKRK (SEQ ID NO: 12) of the influenza virus NS1; the sequence RKLKK-KIKKL (SEQ ID NO: 13) of the Hepatitis virus delta antigen; the sequence REKKKFLKRR (SEQ ID NO: 14) of the mouse Mx1 protein; the sequence KRKGDEVDGVDE-VAKKKSKK (SEQ ID NO: 15) of the human poly(ADP-ribose) polymerase; and the sequence RKCLQAGMN-LEARKTKK (SEQ ID NO: 16) of the steroid hormone receptors (human) glucocorticoid. In general, the one or more NLSs are of sufficient strength to drive accumulation of the Cas in a detectable amount in the nucleus of a eukaryotic cell. In general, strength of nuclear localization activity may derive from the number of NLSs in the Cas, the particular NLS(s) used, or a combination of these factors. Detection of accumulation in the nucleus may be performed by any suitable technique. For example, a detectable marker may be fused to the Cas, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immuno-histochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control no exposed to the Cas or complex, or exposed to a Cas lacking the one or more NLSs.

In certain aspects the invention involves vectors, e.g. for delivering or introducing in a cell Cas and/or RNA capable of guiding Cas to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s) (e.g., sgRNAs); and, when a single vector provides for more than 16 RNA(s) (e.g., sgRNAs), one or more promoter(s) can drive expression of more than one of the RNA(s) (e.g., sgRNAs), e.g., when there are 32 RNA(s) (e.g., sgRNAs), each promoter can drive expression of two RNA(s) (e.g., sgRNAs), and when there are 48 RNA(s) (e.g., sgRNAs), each promoter can drive expression of three RNA(s) (e.g., sgRNAs). By simple arithmetic and well established cloning protocols and the teachings in this disclosure one skilled in the art can readily practice the invention as to the RNA(s) (e.g., sgRNA(s) for a suitable exemplary vector such as AAV, and a suitable promoter such as the U6 promoter, e.g., U6-sgRNAs. For example, the packaging limit of AAV is ~4.7 kb. The length of a single U6-sgRNA (plus restriction sites for cloning) is 361 bp. Therefore, the skilled person can readily fit about 12-16, e.g., 13 U6-sgRNA cassettes in a single vector. This can be assembled by any suitable means, such as a golden gate strategy used for TALE assembly (www.genome-engineering.org/taleffectors/). The skilled person can also use a tandem guide strategy to increase the number of U6-sgRNAs by approximately 1.5 times, e.g., to increase from 12-16, e.g., 13 to approximately 18-24, e.g., about 19 U6-sgRNAs. Therefore, one skilled in the art can readily reach approximately 18-24, e.g., about 19 promoter-RNAs, e.g., U6-sgRNAs in a single vector, e.g., an AAV vector. A further means for increasing the number of promoters and RNAs, e.g., sgRNA(s) in a vector is to use a single promoter (e.g., U6) to express an array of RNAs, e.g., sgRNAs separated by cleavable sequences. And an even further means for increasing the number of promoter-RNAs, e.g., sgRNAs in a vector, is to express an array of promoter-RNAs, e.g., sgRNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjournals.org/content/34/7/e53.short, www.nature.com/mt/journal/v16/n9/abs/mt2008144a.html). In an advantageous embodiment, AAV may package U6 tandem sgRNA targeting up to about 50 genes. Accordingly, from the knowledge in the art and the teachings in this disclosure the skilled person can readily make and use vector(s), e.g., a single vector, expressing multiple RNAs or guides or sgRNAs under the control or operatively or functionally linked to one or more promoters-especially as to the numbers of RNAs or guides or sgRNAs discussed herein, without any undue experimentation.

The guide RNA(s), e.g., sgRNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter (s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

In general, the CRISPR-Cas9 system is as used in the foregoing documents, such as WO 2014/093622 (PCT/US2013/074667) and refers collectively to transcripts and other elements involved in the expression of or directing the activity of CRISPR-associated ("Cas") enzyme, e.g. Cas9, including sequences encoding or delivering a Cas enzyme (DNA and/or RNA-targeting) enzyme, a tracr (trans-activating CRISPR) sequence (e.g., tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas9, e.g., CRISPR RNA (crRNA) and trans-activating crRNA (tracrRNA) or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to target, e.g. have complementarity, where hybridization between a target sequence and a guide sequence promotes the formation of a CRISPR complex. The section of the guide sequence through which complementarity to the target sequence is important for cleavage activity is referred to herein as the seed sequence. A target sequence may comprise any polynucleotide, such as DNA or RNA polynucleotides and is comprised within a target locus of interest. In some embodiments, a target sequence is located in the nucleus or cytoplasm of a cell. The herein described invention encompasses novel effector proteins of Class 2 CRISPR-Cas systems, of which Cas9 is an exemplary effector protein and hence terms used in this application to describe novel effector proteins, may correlate to the terms used to describe the CRISPR-Cas9 system.

The CRISPR-Cas loci has more than 50 gene families and there is no strictly universal genes. Therefore, no single evolutionary tree is feasible and a multi-pronged approach is needed to identify new families. So far, there is comprehensive cas gene identification of 395 profiles for 93 Cas proteins. Classification includes signature gene profiles plus signatures of locus architecture. Class 1 includes multisubunit crRNA-effector complexes (Cascade) and Class 2 includes Single-subunit crRNA-effector complexes (Cas9-like).

The action of the CRISPR-Cas system is usually divided into three stages: (1) adaptation or spacer integration, (2) processing of the primary transcript of the CRISPR locus (pre-crRNA) and maturation of the crRNA which includes the spacer and variable regions corresponding to 5' and 3' fragments of CRISPR repeats, and (3) DNA or RNA interference. Two proteins, Cas1 and Cas2, that are present in the great majority of the known CRISPR-Cas systems are sufficient for the insertion of spacers into the CRISPR cassettes. These two proteins form a complex that is required for this adaptation process; the endonuclease activity of Cas1 is required for spacer integration whereas Cas2 appears to perform a nonenzymatic function. The Cas1-Cas2 complex represents the highly conserved "information processing" module of CRISPR-Cas that appears to be quasi-autonomous from the rest of the system. (See Annotation and Classification of CRISPR-Cas Systems. Makarova K S, Koonin E V. Methods Mol Biol. 2015; 1311:47-75).

The previously described Class 2 systems, namely Type II and the putative Type V, consisted of only three or four genes in the cas operon, namely the cas1 and cas2 genes comprising the adaptation module (the cas1-cas2 pair of genes are not involved in interference), a single multidomain effector protein that is responsible for interference but also contributes to the pre-crRNA processing and adaptation, and often a fourth gene with uncharacterized functions that is dispensable in at least some Type II systems (and in some cases the fourth gene is cas4 (biochemical or in silico evidence shows that Cas4 is a PD-(DE)xK superfamily nuclease with three-cysteine C-terminal cluster; possesses 5'-ssDNA exonuclease activity) or csn2, which encodes an inactivated ATPase). In most cases, a CRISPR array and a gene for a distinct RNA species known as tracrRNA, a trans-encoded small CRISPR RNA, are adjacent to Class 2 cas operons. The tracrRNA is partially homologous to the repeats within the respective CRISPR array and is essential for the processing of pre-crRNA that is catalyzed by RNAse III, a ubiquitous bacterial enzyme that is not associated with the CRISPR-cas loci.

Aspects of the invention relate to the identification and engineering of novel effector proteins associated with CRISPR systems that are Cas protein agnostic. In a preferred embodiment, the effector protein comprises a single-subunit effector module. In a further embodiment the effector protein is functional in prokaryotic or eukaryotic cells for in vitro, in vivo or ex vivo applications. An aspect of the invention encompasses computational methods and algorithms to predict new Cas protein agnostic CRISPR systems and identify the components therein.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats", Edgar, R. C., BMC Bioinformatics, Jan 20; 8:18(2007), herein incorporated by reference.

In a further aspect, the case by case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case by case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELLER software from HHpred alignments.

In one aspect, the present disclosure is directed to a method for identifying novel nucleic acid modifying effectors. In certain example embodiments, the method is directed to identifying novel CRISPR effectors. However, the methods disclosed herein are applicable to other nucleic acid modifying loci that contain conserved genetic elements, such as the conserved repetitive elements found in TALEs and potentially other nucleic acid modifying effectors. Likewise, the nucleic acid modifying activity is not limited to endonuclease activity but any nucleic acid modifying activity including, but not limited to, transposases, recombinases, ligases, glycosylases, topoisomerases, nickases, methylases. It should be further understood that one or more of the steps of the method may be executed on one or more computing devices.

In certain example embodiments, putative nucleic acid modifying loci may be identified from a set of nucleic acid sequences. The set of nucleic acid sequences may be obtained from a genomic or metagenomic database. The genomic or metagenomic database may comprise only prokaryotic genomic sequences, only eukaryotic genomic sequences, or a combination thereof, depending on the nucleic acid modifying loci to be searched. In certain example embodiments, the method comprises obtaining all available prokaryotic genomic sequence from a genomic or metagenomic database repository. Example database repositories include European Ensemble and NCBI databases. A sub-set of nucleic acid sequences comprising the conserved genomic element may then be selected. Tools for searching and identifying the conserved genomic element will depend on the composition of the conserved genomic element to be identified. In certain example embodiments, PILER-CR CRISPR is used to identify genomic sequences comprising one or more CRISPR arrays. R. C. Edgar. "PILER-CR: fast and accurate identification of CRISPR repeats." BMC Bioinformatics. 2007; 8:18.

The assembled set of nucleic acid sequences are then searched to identify putative nucleic acid modifying loci within either a defined distance of the conserved genomic element, loci comprising at least one protein above a defined size limit, or both. Sequences comprising the conserved genomic element are selected from the set of all nucleic acid sequences. The defined distance from the conserved genomic element may be informed by the architecture of known nucleic acid modifying loci of interest. In certain example embodiments, the defined distance is within 25 kb, 24 kb, 23 kb, 22 kb, 21 kb, 20 kb, 19 kb, 18 kb, 17 kb, 16 kb, 15 kb, 14 kb, 13 kb, 12 kb, 11 kb, 10 kb, 9 kb, 8 kb, 7 kb, 6 kb, 5 kb, 4 kb, 3kb, 2 kb, or 1kb of the conserved genomic element. In certain example embodiments, the conserved genomic element is a CRISPR array and the defined distance is within 10 kb of the CRISPR array. The putative nucleic acid modifying loci may be further screened based on whether the loci encode for one or more protein products of a given size. The define size limit of the may be informed by the known characteristics of similar effectors. In certain example embodiments, loci are selected only if the defined size limit is greater than 100, 150, 200, 225, 250, 275, 300, 325, 350, 375, 400, 425, 450, 475, 400, 525, 550, 575, 600, 625, 650, 675, 700, 725, 750, 775, 800, 825, 850, 875, 900, 925, 950, 975, or 1000 amino acids. In certain example embodiments, the size limit is greater than 700 amino acids.

The identified putative nucleic acid modifying loci are then grouped into subsets of loci comprising homologous proteins. In certain example embodiments, homologous proteins are identified by conducting a NCBI BLAST homology search against a protein database, such as the NCBI protein database. Cutoff parameters for the NCBI BLAST homology search may vary between 0 and 1e-15. In certain example embodiments, the cut-off parameter is 1e-7. In certain example embodiments HHpred protein domain homology searches (Soding et al. Nucleic Acids Research. 2005:33 (Web Server Issue):W244-8. doi: 10.1093/nar/gki408) may be conducted on all proteins found in this manner to map putative domains to each putative protein.

In certain example embodiments, a final set of candidate nucleic acid modifying loci are identified from the grouped subsets. In certain example embodiments, the final set of candidate nucleic acid modifying loci are selected based on low HHpred homology matches to known protein domains. Low homology may refer to predicted protein domains of greater than 5, 10, 15, 20, 25, or 30 residues and greater than 50% match to existing known nucleic acid catalytic domains. In certain other example embodiments, low homology may refer to predicted protein domains of greater than 5, 10, 15, 20, 25, or 30 residues and greater than 50% match to existing known nucleic acid catalytic domains. The final set of candidate nucleic acid modifying loci may be further selected based on identical orientation of large putative protein effectors with respect to putative adjacent accessory proteins. Further, based on the total number of single effector candidates within a group, it is possible to assess whether the group is genetically conserved and thus whether it is likely to be biologically functional. Further criteria for selecting a final candidate set of nucleic acid modifying loci may include subsets comprising putative proteins with minimal existing nucleic acid modifying classifications relative to other loci, subsets comprising large putative proteins with a same orientation as any putative small accessory proteins relative to other loci, and loci comprising large putative proteins with shorter distances to the conserved genomic element relative to other loci. This short distance may be within 3000 kb, 2500kb, 2000 kb, 1500 kb, or 1000 kb. In certain example embodiments, the final set of candidate nucleic acid modifying loci is selected from the group comprising the largest number of putative effector proteins. In certain example embodiments, any combination of the above criteria may be used to select a final set of candidate nucleic acid modifying loci.

In certain example embodiments, the final set of candidate nucleic acid modifying loci may be further screened by experimentally validating the nucleic acid modifying function of the candidate nucleic modifying effectors by performing one or more biochemical validation assays, including those biochemical validation assays further disclosed herein.

Candidate nucleic acid modifying loci identified using the above method may then serve as a basis for preparing non-naturally occurring or engineered compositions comprising one or more proteins from the identified nucleic acid modifying loci as further disclosed herein.

In certain example embodiments, a method of identifying a novel CRISPR effector from a genomic database comprises the steps of:
  a) selecting sequences from the database encoding a CRISPR array,
  b) identifying loci located within 10 kb of the CRISPR array comprising Open Reading Frames (ORFs) in the selected sequences from (a),
  c) Selecting from (b) loci comprising ORFs of which only a single ORF encodes a novel CRISPR effector having greater than 700 amino acids and no more than 90% homology to a known CRISPR effector.

In certain other example embodiments, a method of identifying a novel CRISPR effector from a genomic database comprises the steps of:
  a) selecting sequences from the database encoding a CRISPR array, b) identifying loci located within 10 kb of the CRISPR array comprising Open Reading Frames (ORFs) in the selected sequences from (a), c) Selecting from (b) loci comprising ORFs of which only a single ORF encodes a novel CRISPR effector having greater than 700 amino acids; and comparing the secondary structure of the novel CRISPR effector to the secondary structure of a known CRISPR effector, thereby identifying the novel CRISPR effector.

In certain other example embodiments, a method of identifying a novel CRISPR effector from a genomic database comprises the steps of:

a) selecting sequences from the database encoding a CRISPR array, b) identifying loci located within 10 kb of the CRISPR array comprising Open Reading Frames (ORFs) in the selected sequences from (a), c) Selecting from (b) loci comprising ORFs of which only a single ORF encodes a novel CRISPR effector having greater than 700 amino acids; and comparing the secondary structure of the novel CRISPR effector to the secondary structure of a known CRISPR effector, thereby identifying the novel CRISPR effector. The term "nucleic acid-targeting system", wherein nucleic acid is DNA or RNA, and in some aspects may also refer to DNA-RNA hybrids or derivatives thereof, refers collectively to transcripts and other elements involved in the expression of or directing the activity of DNA or RNA-targeting CRISPR-associated ("Cas") genes, which may include sequences encoding a DNA or RNA-targeting Cas protein and a DNA or RNA-targeting guide RNA comprising a CRISPR RNA (crRNA) sequence and (in some but not all systems) a trans-activating CRISPR/Cas system RNA (tracrRNA) sequence, or other sequences and transcripts from a DNA or RNA-targeting CRISPR locus. In general, a RNA-targeting system is characterized by elements that promote the formation of a DNA or RNA-targeting complex at the site of a target DNA or RNA sequence. In the context of formation of a DNA or RNA-targeting complex, "target sequence" refers to a DNA or RNA sequence to which a DNA or RNA-targeting guide RNA is designed to have complementarity, where hybridization between a target sequence and a RNA-targeting guide RNA promotes the formation of a RNA-targeting complex. In some embodiments, a target sequence is located in the nucleus or cytoplasm of a cell.

In an aspect of the invention, novel RNA targeting systems also referred to as RNA-or RNA-targeting CRISPR systems of the present application are based on identified Group 29 or Group 30 proteins which do not require the generation of customized proteins to target specific RNA sequences but rather a single enzyme can be programmed by a RNA molecule to recognize a specific RNA target, in other words the enzyme can be recruited to a specific RNA target using said RNA molecule.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

In an advantageous embodiment, the present invention encompasses effector proteins identified in loci without a proximate Cas1 or Cas2.

Group 29 Nucleases

The activity of Group 29 proteins depends on the presence of two HEPN domains. These have been shown to be RNase domains, i.e. nuclease (in particular an endonuclease) cutting RNA. HEPN may also target DNA, or potentially DNA and/or RNA. On the basis that the HEPN domains of Group 29 proteins are at least capable of binding to and, in their wild-type form, cutting RNA, then it is preferred that the Group 29 effector protein has RNase function. It may also, or alternatively, have DNase function. DNase function, the ability to bind and, potentially cut or nick, DNA is discussed in detail herein.

Thus, in some embodiments, the effector protein may be a RNA-binding protein, such as a dead-Cas type effector protein, which may be optionally functionalised as described herein for instance with an transcriptional activator or repressor domain, NLS or other functional domain. In some embodiments, the effector protein may be a RNA-binding protein that cleaves a single strand of RNA. If the RNA bound is ssRNA, then the ssRNA is fully cleaved. In some embodiments, the effector protein may be a RNA-binding protein that cleaves a double strand of RNA, for example if it comprises two RNase domains. If the RNA bound is dsRNA, then the dsRNA is fully cleaved. In some embodiments, the effector protein may be a RNA-binding protein that has nickase activity, i.e. it binds dsRNA, but only cleaves one of the RNA strands.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA.

Interfering RNA (RNAi) and microRNA (miRNA)

In other embodiments, the target RNA may include interfering RNA, i.e. RNA involved in an RNA interference pathway, such as shRNA, siRNA and so forth. In other embodiments, the target RNA may include microRNA (miRNA). Control over interfering RNA or miRNA may help reduce off-target effects (OTE) seen with those approaches by reducing the longevity of the interfering RNA or miRNA in vivo or in vitro.

If the effector protein and suitable guide are selectively expressed (for example spatially or temporally under the control of a suitable promoter, for example a tissue- or cell cycle-specific promoter and/or enhancer) then this could be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The effector protein may be used to control or bind to molecules comprising or consisting of RNA, such as ribozymes, ribosomes or riboswitches. In embodiments of the invention, the RNA guide can recruit the effector protein to these molecules so that the effector protein is able to bind to them.

Ribosomal RNA (rRNA)

For example, azalide antibiotics such as azithromycin, are well known. They target and disrupt the 50S ribosomal subunit. The present effector protein, together with a suitable guide RNA to target the 50S ribosomal subunit, may be, in some embodiments, recruited to and bind to the 50S ribosomal subunit. Thus, the present effector protein in concert with a suitable guide directed at a ribosomal (especially the 50s ribosomal subunit) target is provided. Use of this use effector protein in concert with the suitable guide directed at the ribosomal (especially the 50s ribosomal subunit) target may include antibiotic use. In particular, the antibiotic use is analogous to the action of azalide antibiotics, such as azithromycin. In some embodiments, prokaryotic ribosomal subunits, such as the 70S subunit in prokaryotes, the 50S subunit mentioned above, the 30S subunit, as well as the 16S and 5S subunits may be targeted. In other embodiments, eukaryotic ribosomal subunits, such as the 80S subunit in eukaryotes, the 60S subunit, the 40S subunit, as well as the 28S, 18S. 5.8S and 5S subunits may be targeted.

In some embodiments, the effector protein may be a RNA-binding protein, optionally functionalised, as described herein. In some embodiments, the effector protein may be a RNA-binding protein that cleaves a single strand of RNA. In either case, but particularly where the RNA-binding protein cleaves a single strand of RNA, then ribosomal function may be modulated and, in particular, reduced or destroyed. This may apply to any ribosomal RNA and any ribosomal subunit and the sequences of rRNA are well known.

Control of ribosomal activity is thus envisaged through use of the present effector protein in concert with a suitable guide to the ribosomal target. This may be through cleavage of, or binding to, the ribosome. In particular, reduction of ribosomal activity is envisaged. This may be useful in assaying ribosomal function in vivo or in vitro, but also as a means of controlling therapies based on ribosomal activity, in vivo or in vitro. Furthermore, control (i.e. reduction) of protein synthesis in an in vivo or in vitro system is envisaged, such control including antibiotic and research and diagnostic use.

Riboswitches

A riboswitch (also known as an aptozyme) is a regulatory segment of a messenger RNA molecule that binds a small molecule. This typically results in a change in production of the proteins encoded by the mRNA. Thus, control of riboswitch activity is thus envisaged through use of the present effector protein in concert with a suitable guide to the riboswitch target. This may be through cleavage of, or binding to, the riboswitch. In particular, reduction of riboswitch activity is envisaged. This may be useful in assaying riboswitch function in vivo or in vitro, but also as a means of controlling therapies based on riboswitch activity, in vivo or in vitro. Furthermore, control (i.e. reduction) of protein synthesis in an in vivo or in vitro system is envisaged. This control, as for rRNA may include antibiotic and research and diagnostic use.

Ribozymes

Ribozymes are RNA molecules having catalytic properties, analogous to enzymes (which are of course proteins). As ribozymes, both naturally occurring and engineered, comprise or consist of RNA, they may also be targeted by the present RNA-binding effector protein. In some embodiments, the effector protein may be a RNA-binding protein cleaves the ribozyme to thereby disable it. Control of ribozymal activity is thus envisaged through use of the present effector protein in concert with a suitable guide to the ribozymal target. This may be through cleavage of, or binding to, the ribozyme. In particular, reduction of ribozymal activity is envisaged. This may be useful in assaying ribozymal function in vivo or in vitro, but also as a means of controlling therapies based on ribozymal activity, in vivo or in vitro.

Gene Expression, Including RNA Processing

The effector protein may also be used, together with a suitable guide, to target gene expression, including via control of RNA processing. The control of RNA processing may include RNA processing reactions such as RNA splicing, including alternative splicing, via targeting of RNApol; viral replication (in particular of satellite viruses, bacteriophages and retroviruses, such as HBV, HBC and HIV and others listed herein) including viroids in plants; and tRNA biosynthesis. The effector protein and suitable guide may also be used to control RNA activation (RNAa). RNAa leads to the promotion of gene expression, so control of gene expression may be achieved that way through disruption or reduction of RNAa and thus less promotion of gene expression.

RNAi Screens

Identifying gene products whose knockdown is associated with phenotypic changes, biological pathways can be interrogated and the constituent parts identified, via RNAi screens. Control may also be exerted over or during these screens by use of the effector protein and suitable guide to remove or reduce the activity of the RNAi in the screen and thus reinstate the activity of the (previously interfered with) gene product (by removing or reducing the interference/repression).

Satellite RNAs (satRNAs) and satellite viruses may also be treated.

Control herein with reference to RNase activity generally means reduction, negative disruption or known-down or knock out.

In Vivo RNA Applications

Inhibition of Gene Expression

The target-specific RNAses provided herein allow for very specific cutting of a target RNA. The interference at RNA level allows for modulation both spatially and temporally and in a non-invasive way, as the genome is not modified.

A number of diseases have been demonstrated to be treatable by mRNA targeting. While most of these studies relate to administration of siRNA, it is clear that the RNA targeting effector proteins provided herein can be applied in a similar way.

Examples of mRNA targets (and corresponding disease treatments) are VEGF, VEGF-R1 and RTP801 (in the treatment of AMD and/or DME), Caspase 2 (in the treatment of Naion)ADRB2 (in the treatment of intraocular pressure), TRPVI (in the treatment of Dry eye syndrome, Syk kinase (in the treatment of asthma), Apo B (in the treatment of hypercholesterolemia), PLK1, KSP and VEGF (in the treatment of solid tumors), Bcr-Abl (in the treatment of C-L) (Burnett and Rossi Chem Biol. 2012, 19(1): 60-71)). Similarly, RNA targeting has been demonstrated to be effective in the treatment of RNA-virus mediated diseases such as HIV (targeting of HIV Tet and Rev), RSV (targeting of RSV nucleocapsid) and HCV (targeting of miR-122) (Burnett and Rossi Chem Biol. 2012, 19(1): 60-71).

It is further envisaged that the RNA targeting effector protein of the invention can be used for mutation specific or allele specific knockdown. Guide RNA's can be designed that specifically target a sequence in the transcribed mRNA comprising a mutation or an allele-specific sequence. Such specific knockdown is particularly suitable for therapeutic applications relating to disorders associated with mutated or allele-specific gene products. For example, most cases of familial hypobetalipoproteinemia (FHBL) are caused by mutations in the ApoB gene. This gene encodes two versions of the apolipoprotein B protein: a short version (ApoB-48) and a longer version (ApoB-100). Several ApoB gene mutations that lead to FHBL cause both versions of ApoB to be abnormally short. Specifically targeting and knockdown of mutated ApoB mRNA transcripts with an RNA targeting effector protein of the invention may be beneficial in treatment of FHBL. As another example, Huntington's disease (HD) is caused by an expansion of CAG triplet repeats in the gene coding for the Huntingtin protein, which results in an abnormal protein. Specifically targeting and knockdown of mutated or allele-specific mRNA transcripts encoding the Huntingtin protein with an RNA targeting effector protein of the invention may be beneficial in treatment of HD.

It is noted that in this context, and more generally for the various applications as described herein, the use of a split version of the RNA targeting effector protein can be envisaged. Indeed, this may not only allow increased specificity but may also be advantageous for delivery. The Cas13b is split in the sense that the two parts of the Cas13b enzyme substantially comprise a functioning Cas13b. Ideally, the split should always be so that the catalytic domain(s) are unaffected. That Cas13b may function as a nuclease or it may be a dead-Cas13b which is essentially an RNA-binding protein with very little or no catalytic activity, due to typically mutation(s) in its catalytic domains.

Each half of the split Cas13b may be fused to a dimerization partner. By means of example, and without limitation, employing rapamycin sensitive dimerization domains, allows to generate a chemically inducible split Cas13b for temporal control of Cas13b activity. Cas13b can thus be rendered chemically inducible by being split into two fragments and that rapamycin-sensitive dimerization domains may be used for controlled reassembly of the Cas13b. The two parts of the split Cas13b can be thought of as the N' terminal part and the C' terminal part of the split Cas13b. The fusion is typically at the split point of the Cas13b. In other words, the C' terminal of the N' terminal part of the split Cas13b is fused to one of the dimer halves, whilst the N' terminal of the C' terminal part is fused to the other dimer half.

The Cas13b does not have to be split in the sense that the break is newly created. The split point is typically designed in silico and cloned into the constructs. Together, the two parts of the split Cas13b, the N' terminal and C' terminal parts, form a full Cas13b, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired Cas13b function is restored or reconstituted. The dimer may be a homodimer or a heterodimer.

In certain embodiments, the Cas13b effector as described herein may be used for mutation-specific, or allele-specific targeting, such as. for mutation-specific, or allele-specific knockdown.

The RNA targeting effector protein can moreover be fused to another functional RNAse domain, such as a non-specific RNase or Argonaute 2, which acts in synergy to increase the RNAse activity or to ensure further degradation of the message.

Modulation of Gene Expression Through Modulation of RNA Function

Apart from a direct effect on gene expression through cleavage of the mRNA, RNA targeting can also be used to impact specific aspects of the RNA processing within the cell, which may allow a more subtle modulation of gene expression. Generally, modulation can for instance be mediated by interfering with binding of proteins to the RNA, such as for instance blocking binding of proteins, or recruiting RNA binding proteins. Indeed, modulations can be ensured at different levels such as splicing, transport, localization, translation and turnover of the mRNA. Similarly in the context of therapy, it can be envisaged to address (pathogenic) malfunctioning at each of these levels by using RNA-specific targeting molecules. In these embodiments it is in many cases preferred that the RNA targeting protein is a "dead" Cas13b that has lost the ability to cut the RNA target but maintains its ability to bind thereto, such as the mutated forms of Cas13b described herein.

a) Alternative Splicing

Many of the human genes express multiple mRNAs as a result of alternative splicing. Different diseases have been shown to be linked to aberrant splicing leading to loss of function or gain of function of the expressed gene. While some of these diseases are caused by mutations that cause splicing defects, a number of these are not. One therapeutic option is to target the splicing mechanism directly. The RNA targeting effector proteins described herein can for instance be used to block or promote slicing, include or exclude exons and influence the expression of specific isoforms and/or stimulate the expression of alternative protein products. Such applications are described in more detail below.

A RNA targeting effector protein binding to a target RNA can sterically block access of splicing factors to the RNA sequence. The RNA targeting effector protein targeted to a splice site may block splicing at the site, optionally redirecting splicing to an adjacent site. For instance a RNA targeting effector protein binding to the 5' splice site binding can block the recruitment of the U1 component of the spliceosome, favoring the skipping of that exon. Alternatively, a RNA targeting effector protein targeted to a splicing enhancer or silencer can prevent binding of transacting regulatory splicing factors at the target site and effectively block or promote splicing. Exon exclusion can further be achieved by recruitment of ILF2/3 to precursor mRNA near an exon by an RNA targeting effector protein as described herein. As yet another example, a glycine rich domain can be attached for recruitment of hnRNP A1 and exon exclusion (Del Gatto-Konczak et al. Mol Cell Biol. 1999 January; 19(1):251-60).

In certain embodiments, through appropriate selection of gRNA, specific splice variants may be targeted, while other splice variants will not be targeted.

In some cases the RNA targeting effector protein can be used to promote slicing (e.g. where splicing is defective). For instance a RNA targeting effector protein can be associated with an effector capable of stabilizing a splicing regulatory stem-loop in order to further splicing. The RNA targeting effector protein can be linked to a consensus binding site sequence for a specific splicing factor in order to recruit the protein to the target DNA.

Examples of diseases which have been associated with aberrant splicing include, but are not limited to Paraneoplastic Opsoclonus Myoclonus Ataxia (or POMA), resulting from a loss of Nova proteins which regulate splicing of proteins that function in the synapse, and Cystic Fibrosis, which is caused by defective splicing of a cystic fibrosis transmembrane conductance regulator, resulting in the production of nonfunctional chloride channels. In other diseases aberrant RNA splicing results in gain-of-function. This is the case for instance in myotonic dystrophy which is caused by a CUG triplet-repeat expansion (from 50 to >1500 repeats) in the 3'UTR of an mRNA, causing splicing defects.

The RNA targeting effector protein can be used to include an exon by recruiting a splicing factor (such as U1) to a 5'splicing site to promote excision of introns around a desired exon. Such recruitment could be mediated trough a fusion with an arginine/serine rich domain, which functions as splicing activator (Gravely B R and Maniatis T, Mol Cell. 1998 (5):765-71).

It is envisaged that the RNA targeting effector protein can be used to block the splicing machinery at a desired locus, resulting in preventing exon recognition and the expression of a different protein product. An example of a disorder that may treated is Duchenne muscular dystrophy (DMD), which is caused by mutations in the gene encoding for the dystrophin protein. Almost all DMD mutations lead to frameshifts, resulting in impaired dystrophin translation. The RNA targeting effector protein can be paired with splice junctions or exonic splicing enhancers (ESEs) thereby preventing exon recognition, resulting in the translation of a partially functional protein. This converts the lethal Duchenne phenotype into the less severe Becker phenotype.

b) RNA Modification

RNA editing is a natural process whereby the diversity of gene products of a given sequence is increased by minor modification in the RNA. Typically, the modification involves the conversion of adenosine (A) to inosine (I), resulting in an RNA sequence which is different from that encoded by the genome. RNA modification is generally ensured by the ADAR enzyme, whereby the pre-RNA target forms an imperfect duplex RNA by base-pairing between the exon that contains the adenosine to be edited and an intronic non-coding element. A classic example of A-I editing is the glutamate receptor GluR-B mRNA, whereby the change results in modified conductance properties of the channel (Higuchi M, et al. Cell. 1993; 75:1361-70).

In humans, a heterozygous functional-null mutation in the ADAR1 gene leads to a skin disease, human pigmentary genodermatosis (Miyamura Y, et al. Am J Hum Genet. 2003; 73:693-9). It is envisaged that the RNA targeting effector proteins of the present invention can be used to correct malfunctioning RNA modification.

It is further envisaged that RNA adenosine methylase (N(6)-methyladenosine) can be fused to the RNA targeting effector proteins of the invention and targeted to a transcript of interest. This methylase causes reversible methylation, has regulatory roles and may affect gene expression and cell fate decisions by modulating multiple RNA-related cellular pathways (Fu et al Nat Rev Genet. 2014; 15(5):293-306).

c) Polyadenylation

Polyadenylation of an mRNA is important for nuclear transport, translation efficiency and stability of the mRNA. and all of these, as well as the process of polyadenylation, depend on specific RBPs. Most eukaryotic mRNAs receive a 3' poly(A) tail of about 200 nucleotides after transcription. Polyadenylation involves different RNA-binding protein complexes which stimulate the activity of a poly(A)polymerase (Minvielle-Sebastia L et al. Curr Opin Cell Biol. 1999; 11:352-7). It is envisaged that the RNA-targeting effector proteins provided herein can be used to interfere with or promote the interaction between the RNA-binding proteins and RNA.

Examples of diseases which have been linked to defective proteins involved in polyadenylation are oculopharyngeal muscular dystrophy (OPMD) (Brais B, et al. Nat Genet. 1998; 18:164-7).

d) RNA Export

After pre-mRNA processing, the mRNA is exported from the nucleus to the cytoplasm. This is ensured by a cellular mechanism which involves the generation of a carrier complex, which is then translocated through the nuclear pore and releases the mRNA in the cytoplasm, with subsequent recycling of the carrier.

Overexpression of proteins (such as TAP) which play a role in the export of RNA has been found to increase export of transcripts that are otherwise ineffeciently exported in Xenopus (Katahira J, et al. EMBO J. 1999; 18:2593-609).

e) mRNA Localization mRNA localization ensures spatially regulated protein production. Localization of transcripts to a specific region of the cell can be ensured by localization elements. In particular embodiments, it is envisaged that the effector proteins described herein can be used to target localization elements to the RNA of interest. The effector proteins can be designed to bind the target transcript and shuttle them to a location in the cell determined by its peptide signal tag. More particularly for instance, a RNA targeting effector protein fused to a nuclear localization signal (NLS) can be used to alter RNA localization.

Further examples of localization signals include the zip code binding protein (ZBP1) which ensures localization of β-actin to the cytoplasm in several asymmetric cell types, KDEL retention sequence (localization to endoplasmic reticulum), nuclear export signal (localization to cytoplasm), mitochondrial targeting signal (localization to mitochondria), peroxisomal targeting signal (localization to peroxisome) and m6A marking/YTHDF2 (localization to p-bodies). Other approaches that are envisaged are fusion of the RNA targeting effector protein with proteins of known localization (for instance membrane, synapse).

Alternatively, the effector protein according to the invention may for instance be used in localization-dependent knockdown. By fusing the effector protein to a appropriate localization signal, the effector is targeted to a particular cellular compartment. Only target RNAs residing in this compartment will effectively be targeted, whereas otherwise identical targets, but residing in a different cellular compartment will not be targeted, such that a localization dependent knockdown can be established.

f) Translation

The RNA targeting effector proteins described herein can be used to enhance or repress translation. It is envisaged that upregulating translation is a very robust way to control cellular circuits. Further, for functional studies a protein translation screen can be favorable over transcriptional upregulation screens, which have the shortcoming that upregulation of transcript does not translate into increased protein production.

It is envisaged that the RNA targeting effector proteins described herein can be used to bring translation initiation factors, such as EIF4G in the vicinity of the 5' untranslated repeat (5'UTR) of a messenger RNA of interest to drive translation (as described in De Gregorio et al. EIBO J. 1999; 18(17):4865-74 for a non-reprogrammable RNA binding protein). As another example GLD2, a cytoplasmic poly(A) polymerase, can be recruited to the target mRNA by an RNA targeting effector protein. This would allow for directed polyadenylation of the target mRNA thereby stimulating translation.

Similarly, the RNA targeting effector proteins envisaged herein can be used to block translational repressors of mRNA, such as ZBP1 (Huttelmaier S, et al. Nature. 2005; 438:512-5). By binding to translation initiation site of a target RNA, translation can be directly affected.

In addition, fusing the RNA targeting effector proteins to a protein that stabilizes mRNAs, e.g. by preventing degradation thereof such as RNase inhibitors, it is possible to increase protein production from the transcripts of interest.

It is envisaged that the RNA targeting effector proteins described herein can be used to repress translation by binding in the 5' UTR regions of a RNA transcript and preventing the ribosome from forming and beginning translation.

Further, the RNA targeting effector protein can be used to recruit Caf1, a component of the CCR4-NOT deadenylase complex, to the target mRNA, resulting in deadenylation or the target transcript and inhibition of protein translation.

For instance, the RNA targeting effector protein of the invention can be used to increase or decrease translation of therapeutically relevant proteins. Examples of therapeutic applications wherein the RNA targeting effector protein can be used to downregulate or upregulate translation are in amyotrophic lateral sclerosis (ALS) and cardiovascular disorders. Reduced levels of the glial glutamate transporter EAAT2 have been reported in ALS motor cortex and spinal cord, as well as multiple abnormal EAAT2 mRNA transcripts in ALS brain tissue. Loss of the EAAT2 protein and function thought to be the main cause of excitotoxicity in ALS. Restoration of EAAT2 protein levels and function may provide therapeutic benefit. Hence, the RNA targeting effector protein can be beneficially used to upregulate the expression of EAAT2 protein, e.g. by blocking translational repressors or stabilizing mRNA as described above. Apolipoprotein A1 is the major protein component of high density lipoprotein (HDL) and ApoA1 and HDL are generally considered as atheroprotective. It is envisages that the RNA targeting effector protein can be beneficially used to upregulate the expression of ApoA1, e.g. by blocking translational repressors or stabilizing mRNA as described above.

g) mRNA Turnover

Translation is tightly coupled to mRNA turnover and regulated mRNA stability. Specific proteins have been described to be involved in the stability of transcripts (such as the ELAV/Hu proteins in neurons, Keene J D, 1999, Proc Natl Acad Sci USA. 96:5-7) and tristetraprolin (TTP). These proteins stabilize target mRNAs by protecting the messages from degradation in the cytoplasm (Peng S S et al., 1988, EMBO J. 17:3461-70).

It can be envisaged that the RNA-targeting effector proteins of the present invention can be used to interfere with or to promote the activity of proteins acting to stabilize mRNA transcripts, such that mRNA turnover is affected. For instance, recruitment of human TTP to the target RNA using the RNA targeting effector protein would allow for adenylate-uridylate-rich element (AU-rich element) mediated translational repression and target degradation. AU-rich elements are found in the 3' UTR of many mRNAs that code for proto-oncogenes, nuclear transcription factors, and cytokines and promote RNA stability. As another example, the RNA targeting effector protein can be fused to HuR, another mRNA stabilization protein (Hinman M N and Lou H, Cell Mol Life Sci 2008; 65:3168-81), and recruit it to a target transcript to prolong its lifetime or stabilize short-lived mRNA.

It is further envisaged that the RNA-targeting effector proteins described herein can be used to promote degradation of target transcripts. For instance, m6A methyltransferase can be recruited to the target transcript to localize the transcript to P-bodies leading to degradation of the target.

As yet another example, an RNA targeting effector protein as described herein can be fused to the non-specific endonuclease domain PilT N-terminus (PIN), to recruit it to a target transcript and allow degradation thereof.

Patients with paraneoplastic neurological disorder (PND)-associated encephalomyelitis and neuropathy are patients who develop autoantibodies against Hu-proteins in tumors outside of the central nervous system (Szabo A et al. 1991, Cell.; 67:325-33 which then cross the blood-brain barrier. It can be envisaged that the RNA-targeting effector proteins of the present invention can be used to interfere with the binding of auto-antibodies to mRNA transcripts.

Patients with dystrophy type 1 (DM1), caused by the expansion of (CUG)n in the 3' UTR of dystrophia myotonica-protein kinase (DMPK) gene, are characterized by the accumulation of such transcripts in the nucleus. It is envisaged that the RNA targeting effector proteins of the invention fused with an endonuclease targeted to the (CUG)n repeats could inhibit such accumulation of aberrant transcripts.

h) Interaction with Multi-Functional Proteins

Some RNA-binding proteins bind to multiple sites on numerous RNAs to function in diverse processes. For instance, the hnRNP A1 protein has been found to bind exonic splicing silencer sequences, antagonizing the splicing factors, associate with telomere ends (thereby stimulating telomere activity) and bind miRNA to facilitate Drosha-mediated processing thereby affecting maturation. It is envisaged that the RNA-binding effector proteins of the present invention can interfere with the binding of RNA-binding proteins at one or more locations.

i) RNA Folding

RNA adopts a defined structure in order to perform its biological activities. Transitions in conformation among alternative tertiary structures are critical to most RNA-mediated processes. However, RNA folding can be associated with several problems. For instance, RNA may have a tendency to fold into, and be upheld in, improper alternative conformations and/or the correct tertiary structure may not be sufficiently thermodynamically favored over alternative structures. The RNA targeting effector protein, in particular a cleavage-deficient or dead RNA targeting protein, of the invention may be used to direct folding of (m)RNA and/or capture the correct tertiary structure thereof.

Use of RNA-Targeting Effector Protein in Modulating Cellular Status

In certain embodiments Cas13b in a complex with crRNA is activated upon binding to target RNA and subsequently cleaves any nearby ssRNA targets (i.e. "collateral" or "bystander" effects). Cas13b, once primed by the cognate target, can cleave other (non-complementary) RNA molecules. Such promiscuous RNA cleavage could potentially cause cellular toxicity, or otherwise affect cellular physiology or cell status.

Accordingly, in certain embodiments, the non-naturally occurring or engineered composition, vector system, or delivery systems as derscribed herein are used for or are for use in induction of cell dormancy. In certain embodiments, the non-naturally occurring or engineered composition, vector system, or delivery systems as derscribed herein are used for or are for use in induction of cell cycle arrest. In certain embodiments, the non-naturally occurring or engineered composition, vector system, or delivery systems as derscribed herein are used for or are for use in reduction of cell growth and/or cell proliferation, In certain embodiments, the non-naturally occurring or engineered composition, vector system, or delivery systems as derscribed herein are used for or are for use in induction of cell anergy. In certain embodiments, the non-naturally occurring or engineered composition, vector system, or delivery systems as derscribed herein are used for or are for use in induction of cell apoptosis. In certain embodiments, the non-naturally occurring or engineered composition, vector system, or delivery systems as derscribed herein are used for or are for use in incuction of cell necrosis. In certain embodiments, the non-naturally occurring or engineered composition, vector system, or delivery systems as derscribed herein are used for or are for use in induction of cell death. In certain embodiments, the non-naturally occurring or engineered composition, vector system, or delivery systems as derscribed herein are used for or are for use in induction of programmed cell death.

In certain embodiments, the invention relates to a method for induction of cell dormancy comprising introducing or inducing the non-naturally occurring or engineered composition, vector system, or delivery systems as derscribed herein. In certain embodiments, the invention relates to a method for induction of cell cycle arrest comprising introducing or inducing the non-naturally occurring or engineered composition, vector system, or delivery systems as derscribed herein. In certain embodiments, the invention relates to a method for reduction of cell growth and/or cell proliferation comprising introducing or inducing the non-naturally occurring or engineered composition, vector system, or delivery systems as derscribed herein. In certain embodiments, the invention relates to a method for induction of cell anergy comprising introducing or inducing the non-naturally occurring or engineered composition, vector system, or delivery systems as derscribed herein. In certain embodiments, the invention relates to a method for induction of cell apoptosis comprising introducing or inducing the non-naturally occurring or engineered composition, vector system, or delivery systems as derscribed herein. In certain embodiments, the invention relates to a method for induction of cell necrosis comprising introducing or inducing the non-naturally occurring or engineered composition, vector system, or delivery systems as derscribed herein. In certain embodiments, the invention relates to a method for induction of cell death comprising introducing or inducing the non-naturally occurring or engineered composition, vector system, or delivery systems as derscribed herein. In certain embodiments, the invention relates to a method for induction of programmed cell death comprising introducing or inducing the non-naturally occurring or engineered composition, vector system, or delivery systems as derscribed herein.

The methods and uses as described herein may be therapeutic or prophylactic and may target particular cells, cell (sub)populations, or cell/tissue types. In particular, the methods and uses as described herein may be therapeutic or prophylactic and may target particular cells, cell (sub) populations, or cell/tissue types expressing one or more target sequences, such as one or more particular target RNA (e.g. ss RNA). Without limitation, target cells may for instance be cancer cells expressing a particular transcript, e.g. neurons of a given class, (immune) cells causing e.g. autoimmunity, or cells infected by a specific (e.g. viral) pathogen, etc.

Accordingly, in certain embodiments, the invention relates to a method for treating a pathological condition characterized by the presence of undersirable cells (host cells), comprising introducing or inducing the non-naturally occurring or engineered composition, vector system, or delivery systems as derscribed herein. In certain embodiments, the invention relates the use of the non-naturally occurring or engineered composition, vector system, or delivery systems as derscribed herein for treating a pathological condition characterized by the presence of undersirable cells (host cells). In certain embodiments, the invention relates the non-naturally occurring or engineered composition, vector system, or delivery systems as derscribed herein for use in treating a pathological condition characterized by the presence of undersirable cells (host cells). It is to be understood that preferably the CRISPR-Cas system targets a target specific for the undesirable cells. In certain embodiments, the invention relates to the use of the non-naturally occurring or engineered composition, vector system, or delivery systems as derscribed herein for treating, preventing, or alleviating cancer. In certain embodiments, the invention relates to the non-naturally occurring or engineered composition, vector system, or delivery systems as derscribed herein for use in treating, preventing, or alleviating cancer. In certain embodiments, the invention relates to a method for treating, preventing, or alleviating cancer comprising introducing or inducing the non-naturally occurring or engineered composition, vector system, or delivery systems as derscribed herein. It is to be understood that preferably the CRISPR-Cas system targets a target specific for the cancer cells. In certain embodiments, the invention relates to the use of the non-naturally occurring or engineered composition, vector system, or delivery systems as derscribed herein for treating, preventing, or alleviating infection of cells by a pathogen. In certain embodiments, the invention relates to the non-naturally occurring or engineered composition, vector system, or delivery systems as derscribed herein for use in treating, preventing, or alleviating infection of cells by a pathogen. In certain embodiments, the invention relates to a method for treating, preventing, or alleviating infection of cells by a pathogen comprising introducing or inducing the non-naturally occurring or engineered composition, vector system, or delivery systems as derscribed herein. It is to be understood that preferably the CRISPR-Cas system targets a target specific for the cells infected by the pathogen (e.g. a pathogen derived target). In certain embodiments, the invention relates to the use of the non-naturally occurring or engineered composition, vector system, or delivery systems as derscribed herein for treating, preventing, or alleviating an autoimmune disorder. In certain embodiments, the invention relates to the non-naturally occurring or engineered composition, vector system, or delivery systems as derscribed herein for use in treating, preventing, or alleviating an autoimmune disorder. In certain embodiments, the invention relates to a method for treating, preventing, or alleviating an autoimmune disorder comprising introducing or inducing the non-naturally occurring or engineered composition, vector system, or delivery systems as derscribed herein. It is to be understood that preferably the CRISPR-Cas system targets a target specific for the cells responsible for the autoimmune disorder (e.g. specific immune cells).

Use of RNA-Targeting Effector Protein in RNA Detection

It is further envisaged that the RNA targeting effector protein can be used in Northern blot assays. Northern blotting involves the use of electrophoresis to separate RNA samples by size. The RNA targeting effector protein can be used to specifically bind and detect the target RNA sequence.

A RNA targeting effector protein can be fused to a fluorescent protein (such as GFP) and used to track RNA localization in living cells. More particularly, the RNA targeting effector protein can be inactivated in that it no longer cleaves RNA. In particular embodiments, it is envisaged that a split RNA targeting effector protein can be used, whereby the signal is dependent on the binding of both subproteins, in order to ensure a more precise visualization. Alternatively, a split fluorescent protein can be used that is reconstituted when multiple RNA targeting effector protein complexes bind to the target transcript. It is further envisaged that a transcript is targeted at multiple binding sites along the mRNA so the fluorescent signal can amplify the true signal and allow for focal identification. As yet another alternative, the fluorescent protein can be reconstituted form a split intein.

RNA targeting effector proteins are for instance suitably used to determine the localization of the RNA or specific splice variants, the level of mRNA transcript, up- or down-regulation of transcripts and disease-specific diagnosis. The RNA targeting effector proteins can be used for visualization of RNA in (living) cells using e.g. fluorescent microscopy or flow cytometry, such as fluorescence-activated cell sorting (FACS) which allows for high-throughput screening of cells and recovery of living cells following cell sorting. Further, expression levels of different transcripts can be assessed simultaneously under stress, e.g. inhibition of cancer growth using molecular inhibitors or hypoxic conditions on cells. Another application would be to track localization of transcripts to synaptic connections during a neural stimulus using two photon microscopy.

In certain embodiments, the components or complexes according to the invention as described herein can be used in multiplexed error-robust fluorescence in situ hybridization (MERFISH; Chen et al. Science; 2015; 348(6233)), such as for instance with (fluorescently) labeled Cas13b effectors.

In Vitro Apex Labeling

Cellular processes depend on a network of molecular interactions among protein, RNA, and DNA. Accurate detection of protein-DNA and protein-RNA interactions is key to understanding such processes. In vitro proximity labeling technology employs an affinity tag combined with e.g. a photoactivatable probe to label polypeptides and RNAs in the vicinity of a protein or RNA of interest in vitro. After UV irradiation the photoactivatable group reacts with proteins and other molecules that are in close proximity to the tagged molecule, thereby labelling them. Labelled interacting molecules can subsequently be recovered and identified. The RNA targeting effector protein of the invention can for instance be used to target a probe to a selected RNA sequence.

These applications could also be applied in animal models for in vivo imaging of disease relevant applications or difficult-to culture cell types. Use of RNA-targeting effector protein in RNA origami/in vitro assembly lines—combinatorics RNA origami refers to nanoscale folded structures for creating two-dimensional or three-dimensional structures using RNA as integrated template. The folded structure is encoded in the RNA and the shape of the resulting RNA is thus determined by the synthesized RNA sequence (Geary, et al. 2014. Science, 345 (6198). pp. 799-804). The RNA origami may act as scaffold for arranging other components, such as proteins, into complexes. The RNA targeting effector protein of the invention can for instance be used to target proteins of interest to the RNA origami using a suitable guide RNA.

These applications could also be applied in animal models for in vivo imaging of disease relevant applications or difficult-to culture cell types.

Use of RNA-Targeting Effector Protein in RNA Isolation or Purification, Enrichment or Depletion It is further envisages that the RNA targeting effector protein when complexed to RNA can be used to isolate and/or purify the RNA. The RNA targeting effector protein can for instance be fused to an affinity tag that can be used to isolate and/or purify the RNA-RNA targeting effector protein complex. Such applications are for instance useful in the analysis of gene expression profiles in cells.

In particular embodiments, it can be envisaged that the RNA targeting effector proteins can be used to target a specific noncoding RNA (ncRNA) thereby blocking its activity, providing a useful functional probe. In certain embodiments, the effector protein as described herein may be used to specifically enrich for a particular RNA (including but not limited to increasing stability, etc.), or alternatively to specifically deplete a particular RNA (such as without limitation for instance particular splice variants, isoforms, etc.).

Interrogation of lincRNA Function and Other Nuclear RNAs

Current RNA knockdown strategies such as siRNA have the disadvantage that they are mostly limited to targeting cytosolic transcripts since the protein machinery is cytosolic. The advantage of a RNA targeting effector protein of the present invention, an exogenous system that is not essential to cell function, is that it can be used in any compartment in the cell. By fusing a NLS signal to the RNA targeting effector protein, it can be guided to the nucleus, allowing nuclear RNAs to be targeted. It is for instance envisaged to probe the function of lincRNAs. Long intergenic non-coding RNAs (lincRNAs) are a vastly underexplored area of research. Most lincRNAs have as of yet unknown functions which could be studies using the RNA targeting effector protein of the invention.

Identification of RNA Binding Proteins

Identifying proteins bound to specific RNAs can be useful for understanding the roles of many RNAs. For instance, many lincRNAs associate with transcriptional and epigenetic regulators to control transcription. Understanding what proteins bind to a given lincRNA can help elucidate the components in a given regulatory pathway. A RNA targeting effector protein of the invention can be designed to recruit a biotin ligase to a specific transcript in order to label locally bound proteins with biotin. The proteins can then be pulled down and analyzed by mass spectrometry to identify them.

Assembly of Complexes on RNA and Substrate Shuttling

RNA targeting effector proteins of the invention can further be used to assemble complexes on RNA. This can be achieved by functionalizing the RNA targeting effector protein with multiple related proteins (e.g. components of a particular synthesis pathway). Alternatively, multiple RNA targeting effector proteins can be functionalized with such different related proteins and targeted to the same or adjacent target RNA. Useful application of assembling complexes on RNA are for instance facilitating substrate shuttling between proteins.

Synthetic Biology

The development of biological systems have a wide utility, including in clinical applications. It is envisaged that the programmable RNA targeting effector proteins of the invention can be used fused to split proteins of toxic domains for targeted cell death, for instance using cancer-linked RNA as target transcript. Further, pathways involving protein-protein interaction can be influenced in synthetic biological systems with e.g. fusion complexes with the appropriate effectors such as kinases or other enzymes.

Protein Splicing: Inteins

Protein splicing is a post-translational process in which an intervening polypeptide, referred to as an intein, catalyzes its own excision from the polypeptides flacking it, referred to as exteins, as well as subsequent ligation of the exteins. The assembly of two or more RNA targeting effector proteins as described herein on a target transcript could be used to direct the release of a split intein (Topilina and Mills Mob DNA. 2014 Feb. 4; 5(1):5), thereby allowing for direct computation of the existence of a mRNA transcript and subsequent release of a protein product, such as a metabolic enzyme or a transcription factor (for downstream actuation of transcription pathways). This application may have significant relevance in synthetic biology (see above) or large-scale bio-production (only produce product under certain conditions).

Inducible, Dosed and Self-Inactivating Systems

In one embodiment, fusion complexes comprising an RNA targeting effector protein of the invention and an effector component are designed to be inducible, for instance light inducible or chemically inducible. Such inducibility allows for activation of the effector component at a desired moment in time.

Light inducibility is for instance achieved by designing a fusion complex wherein CRY2 PHR/CIBN pairing is used for fusion. This system is particularly useful for light induction of protein interactions in living cells (Konermann S, et al. Nature. 2013; 500:472-476).

Chemical inducibility is for instance provided for by designing a fusion complex wherein FKBP/FRB (FK506 binding protein/FKBP rapamycin binding) pairing is used for fusion. Using this system rapamycin is required for binding of proteins (Zetsche et al. Nat Biotechnol. 2015; 33(2):139-42 describes the use of this system for Cas9).

Further, when introduced in the cell as DNA, the RNA targeting effector protein of the inventions can be modulated by inducible promoters, such as tetracycline or doxycycline controlled transcriptional activation (Tet-On and Tet-Off expression system), hormone inducible gene expression system such as for instance an ecdysone inducible gene expression system and an arabinose-inducible gene expression system. When delivered as RNA, expression of the RNA targeting effector protein can be modulated via a riboswitch, which can sense a small molecule like tetracycline (as described in Goldfless et al. Nucleic Acids Res. 2012; 40(9):e64).

In one embodiment, the delivery of the RNA targeting effector protein of the invention can be modulated to change the amount of protein or crRNA in the cell, thereby changing the magnitude of the desired effect or any undesired off-target effects.

In one embodiment, the RNA targeting effector proteins described herein can be designed to be self-inactivating. When delivered to a cell as RNA, either mRNA or as a replication RNA therapeutic (Wrobleska et al Nat Biotechnol. 2015 August; 33(8): 839-841), they can self-inactivate expression and subsequent effects by destroying the own RNA, thereby reducing residency and potential undesirable effects.

For further in vivo applications of RNA targeting effector proteins as described herein, reference is made to Mackay J P et al (Nat Struct Mol Biol. 2011 March; 18(3):256-61), Nelles et al (Bioessays. 2015 July; 37(7):732-9) and Abil Z and Zhao H (Mol Biosyst. 2015 Oct.;11(10):2658-65), which are incorporated herein by reference. In particular, the following applications are envisaged in certain embodiments of the invention, preferably in certain embodiments by using catalytically inactive Cas13b: enhancing translation (e.g. Cas13b—translation promotion factor fusions (e.g. eIF4 fusions)); repressing translation (e.g. gRNA targeting ribosome binding sites); exon skipping (e.g. gRNAs targeting splice donor and/or acceptor sites); exon inclusion (e.g. gRNA targeting a particular exon splice donor and/or acceptor site to be included or Cas13b fused to or recruiting spliceosome components (e.g. U1 snRNA)); accessing RNA localization (e.g. Cas13b—marker fusions (e.g. EGFP fusions)); altering RNA localization (e.g. Cas13b—localization signal fusions (e.g. NLS or NES fusions)); RNA degradation (in this case no catalytically inactive Cas13b is to be used if relied on the activity of Cas13b, alternatively and for increased specificity, a split Cas13b may be used); inhibition of non-coding RNA function (e.g. miRNA), such as by degradation or binding of gRNA to functional sites (possibly titrating out at specific sites by relocalization by Cas13b-signal sequence fusions).

As described herein before and demonstrated in the Examples, Cas13b function is robust to 5' or 3' extensions of the crRNA and to extension of the crRNA loop. It is therefore envisages that MS2 loops and other recruitment domains can be added to the crRNA without affecting complex formation and binding to target transcripts. Such modifications to the crRNA for recruitment of various effector domains are applicable in the uses of a RNA targeted effector proteins described above.

As demonstrated in the Examples, Cas13b, in particular BzCas13b, is capable of mediating resistance to RNA phages. It is therefore envisaged that Cas13b can be used to immunize, e.g. animals, humans and plants, against RNA-only pathogens, including but not limited to Ebola virus and Zika virus.

In certain embodiments, Cas13b can process (cleave) its own array. This applies to both the wildtype Cas13b protein and the mutated Cas13b protein containing one or more mutated amino acid residues R116, H121, R1177 and H1182, such as one or more of the modifications selected from R116A, H121A, R1177A and H1182A. It is therefore envisaged that multiple crRNAs designed for different target transcripts and/or applications can be delivered as a single pre-crRNA or as a single transcript driven by one promotor. Such method of delivery has the advantages that it is substantially more compact, easier to synthesize and easier to delivery in viral systems. Preferably, amino acid numbering as described herein refers to BzCas13b protein. It will be understood that exact amino acid positions may vary for orthologues of BzCas13b, which can be adequately determined by protein alignment, as is known in the art, and as described herein elsewhere. Aspects of the invention also encompass methods and uses of the compositions and systems described herein in genome engineering, e.g. for altering or manipulating the expression of one or more genes or the one or more gene products, in prokaryotic or eukaryotic cells, in vitro, in vivo or ex vivo.

In an aspect, the invention provides methods and compositions for modulating, e.g., reducing, expression of a target RNA in cells. In the subject methods, a Cas13b system of the invention is provided that interferes with transcription, stability, and/or translation of an RNA.

In certain embodiments, an effective amount of Cas13b system is used to cleave RNA or otherwise inhibit RNA expression. In this regard, the system has uses similar to siRNA and shRNA, thus can also be substituted for such methods. The method includes, without limitation, use of a Cas13b system as a substitute for e.g., an interfering ribonucleic acid (such as an siRNA or shRNA) or a transcription template thereof, e.g., a DNA encoding an shRNA. The Cas13b system is introduced into a target cell, e.g., by being administered to a mammal that includes the target cell.

Advantageously, a Cas13b system of the invention is specific. For example, whereas interfering ribonucleic acid (such as an siRNA or shRNA) polynucleotide systems are plagued by design and stability issues and off-target binding, a Cas13b system of the invention can be designed with high specificity.

Destabilized Cas13b

In certain embodiments, the effector protein (CRISPR enzyme; Cas13b) according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8. In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-Cas13b or DHFR-DHFR-Cas13b It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a GlySer linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the CRISPR enzyme comprises or consists essentially of or consists of a localization (nuclear import or export) signal as, or as part of, the linker between the CRISPR enzyme and the DD. HA or Flag tags are also within the ambit of the invention as linkers. Applicants use NLS and/or NES as linker and also use artificial Glycine Serine linkers as short as GS up to (GGGGS)3.

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.6,7 This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a CRISPR enzyme confers to the CRISPR protein degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a CRISPR enzyme and its stability can be regulated or perturbed using a ligand, whereby the CRISPR enzyme has a DD. Another DD can be a 12-kDa (107-amino-acid) tag based on a mutated FKBP protein, stabilized by Shieldi ligand; see, e.g., Nature Methods 5, (2008). For instance a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19(3): 391-398-all of which are incorporated herein by reference and may be employed in the practice of the invention in selected a DD to associate with a CRISPR enzyme in the practice of this invention. As can be seen, the knowledge in the art includes a number of DDs, and the DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the CRISPR enzyme and hence the CRISPR-Cas complex or system to be regulated or controlled turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand. Application of RNA Targeting-CRISPR System to Plants and Yeast Definitions In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, *eucalyptus*, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, *papaya*, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for modulating gene expression using the RNA targeting system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those ronocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., *petunia*, rose, *chrysanthemum*), conifers and pine trees (e.g. pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magnoliales, Illiciales, Laurales, Piperales, Aristochiales, Nymphaeales, Ranunculales, Papeverales, Sarraceniaceae, Trochodendrales, Hamarmelidales, Eucomiales, Leitneriales, Myricales, Fagales, Casuarinales, Cary ophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Ratflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanul ales, Rubiales, Dipsacales, and Asterales: the methods and CRISPR-Cas systems can be used with monocotyledonous plants such as those belonging to the orders Alisrnatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Liliales, and Orchid ales, or with plants belonging to Gymnospermae, e.g those belonging to the orders Pinales, Ginkgoales, Cycadales, Araucariales, Cupressales and Gnetales.

The RNA targeting CRISPR systems and methods of use described herein can be used over a broad range of plant species, included in the non-limitative list of dicot, monocot or gymnosperm genera hereunder: *Atropa*, Allseodaphne, Anacardiumn, *Arachis, Beilschmniedia, Brassica,* Carthamwus, Cocculus, Croton, *Cucumis, Citrus*, (itrullus, Capsicunm, Catharanthus, *Cocos*, CotfPa, *Cucurbita, Dacuss*, Duguetia, *Eschscholzia, Ficus,* Fragaria, Glauciumn, Glycine, *Gossypium.*, *Helianthus*, evea, Hyoscynus, *Lactuca, Landolphia, Linum*, Litseca, iLvcopersicon, *Lupinus, Manihot,* Mfajoranra, Malus, *Medicago, Ncotlana, Olea, Parthenimn, Papaver, Persea, Phaseolus, Pistacia, Pisum, Pyrus, Priunus, Raphanus, Ricinus, Senecio, Sinomenin, Stephania, sinapis, Solanum, Theobroma, Tirfolium, Tigonella, Vicia, Vinca,* Jllis, and *Vigna*; and the genera *Allium, Andropogon, Eragrostis, Asparagus, Avena,* Cvnodon, heis, *Festuca, Festulolium, Heterocallis, Hordeum, Lemna, Lolium, Mus Oryza, Panicum, Pennisetum, phleum,* Poa, *Secale, Sorghum,* Triticmn, *Zea, Abies,* Cunningharnia, Ehed'a, Piceca, *Pinus,* and *Pseudotsuga.*

The RNA targeting CRISPR systems and methods of use can also be used over a broad range of "algae" or "algae cells"; including for example algea selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: Amphora, *Anabaena, Ankistrodesmus, Botryococcus, Chaetoceros, Chlamydomonas, Chlorella,* Chlorococcum, Cyclotella, Cylindrotheca, *Dunaliella,* Emiliana., *Euglena, Haematococcus, Isochrysis,* Monochrysis, Monoraphidiurn, Nannochloris, *Nannochloropsis,* Navicula, Nephrochloris, Nephroselmis, *Nitzschia, Nodularia, Nostoc,* Oochromonas, Oocystis, Oscillatoria, Pavlova, Phaeodactylun, Platymonas, *Pleurochrysis, Porphyra,* Pseudoanabaena, Pyramimonas, Stichococcus, Synechococcus, *Synechocystis, Tetraselmis, Thalassiosira,* and Trichodesmium.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendents of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an S. cerervisiae, *Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and Issatchenkia spp. (e.g., Issatchenkia *orientalis*, a.k.a. *Pichia* kudriavzevii and *Candida* acidothermophilum). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella* isabellina).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guideRNA may more often be a rate-limiting component in genome engineering of polyploid cells than in haploid cells, and thus the methods using the Cas13b CRISPR system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2 plasmids, yeast integrative plasmids, yeast replicative plasmids, shuttle vectors, and episomal plasmids.

Stable Integration of RNA Targeting CRISP System Components in the Genome of Plants and Plant Cells In particular embodiments, it is envisaged that the polynucleotides encoding the components of the RNA targeting CRISPR system are introduced for stable integration into the genome of a plant cell. In these embodiments, the design of the transformation vector or the expression system can be adjusted depending on when, where and under what conditions the guide RNA and/or the RNA targeting gene(s) are expressed.

In particular embodiments, it is envisaged to introduce the components of the RNA targeting CRISPR system stably into the genomic DNA of a plant cell. Additionally or alternatively, it is envisaged to introduce the components of the RNA targeting CRISPR system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the guide RNA and/or RNA targeting enzyme in a plant cell; a 5' untranslated region to enhance expression; an intron element to further enhance expression in certain cells, such as monocot cells; a multiple-cloning site to provide convenient restriction sites for inserting the one or more guide RNAs and/or the RNA targeting gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a RNA targeting CRISPR expression system comprises at least:
  (a) a nucleotide sequence encoding a guide RNA (gRNA) that hybridizes with a target sequence in a plant, and wherein the guide RNA comprises a guide sequence and a direct repeat sequence, and
  (b) a nucleotide sequence encoding a RNA targeting protein, wherein components (a) or (b) are located on the same or on different constructs, and whereby the different nucleotide sequences can be under control of the same or a different regulatory element operable in a plant cell.

DNA construct(s) containing the components of the RNA targeting CRISPR system, may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(i):11-9). The basis of particle bombardment is the acceleration of particles coated with gene/s of interest toward cells, resulting in the penetration of the protoplasm by the particles and typically stable integration into the genome. (see e.g. Klein ct al, Nature (1987), Klein et ah, Bio/Technology (1992), Casas et ah, Proc. Natl. Acad. Sci. USA (1993).).

In particular embodiments, the DNA constructs containing components of the RNA targeting CRISPR system may be introduced into the plant by Agrobacterinm-mediated transformation. The DNA constructs may be combined with suitable T-DNA flanking regions and introduced into a conventional Agrobacterin lumefaiciens host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the Cas13b CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. The present invention envisages methods for modifying RNA sequences and as such also envisages regulating expression of plant biomolecules. In particular embodiments of the present invention it is thus advantageous to place one or more elements of the RNA targeting CRISPR system under the control of a promoter that can be regulated. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the RNA targeting CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the RNA targeting CRISPR system are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome)., such as a Light Inducible Transcriptional Effector (LITE) that direct changes in transcriptional activity in a sequence-specific manner. The components of a light inducible system may include a RNA targeting CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promoters, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chhoroplast Targeting

In particular embodiments, it is envisaged that the RNA targeting CRISPR system is used to specifically modify expression and/or translation of chloroplast genes or to ensure expression in the chloroplast. For this purpose use is made of chloroplast transformation methods or compartmentalization of the RNA targeting CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the RNA targeting CRISPR components to the plant chloroplast. This is achieved by incorporating in the expression construct a sequence encoding a chloroplast transit peptide (CTP) or plastid transit peptide, operably linked to the 5' region of the sequence encoding the RNA targeting protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the one or more guide RNAs to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the RNA targeting-guide RNA(s).

Introduction of Polynucleotides Encoding the CRISPR-RNA Targeting System in Algal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, RNA targeting protein and guide RNA(s) are introduced in algae expressed using a vector that expresses RNA targeting protein under the control of a constitutive promoter such as Hsp70A-Rbc S2 or Beta2- tubulin. Guide RNA is optionally delivered using a vector containing T7 promoter. Alternatively, RNA targeting mRNA and in vitro transcribed guide RNA can be delivered to algal cells. Electroporation protocols are available to the skilled person such as the standard recommended protocol from the GeneArt *Chlamydomonas* Engineering kit.

Introduction of Polynucleotides Encoding RNA Targeting Components in Yeast Cells In particular embodiments, the invention relates to the use of the RNA targeting CRISPR system for RNA editing in yeast cells. Methods for transforming yeast cells which can be used to introduce polynucleotides encoding the RNA targeting CRISPR system components are well known to the artisan and are reviewed by Kawai et al., 2010, Bioeng Bugs. 2010 Nov.-Dec; 1(6): 395-403). Non-limiting examples include transformation of yeast cells by lithium acetate treatment (which may further include carrier DNA and PEG treatment), bombardment or by electroporation.

Transient Expression of RNA Targeting CRISP System Components in Plants and Plant Cell In particular embodiments, it is envisaged that the guide RNA and/or RNA targeting gene are transiently expressed in the plant cell. In these embodiments, the RNA targeting CRISPR system can ensure modification of RNA target molecules only when both the guide RNA and the RNA targeting protein is present in a cell, such that gene expression can further be controlled. As the expression of the RNA targeting enzyme is transient, plants regenerated from such plant cells typically contain no foreign DNA. In particular embodiments the RNA targeting enzyme is stably expressed by the plant cell and the guide sequence is transiently expressed, In particularly preferred embodiments, the RNA targeting CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors, which is of interest in the context of avoiding the production of GMO plants.

In particular embodiments, the vector used for transient expression of RNA targeting CRISPR constructs is for instance a pEAQ vector, which is tailored for Agrobacteriun-mediated transient expression (Sainsbury F. et al., Plant Biotechnol J. 2009 Sep; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10,1038/srep14926).

In particular embodiments, double-stranded DNA fragments encoding the guide RNA and/or the RNA targeting gene can be transiently introduced into the plant cell. In such embodiments, the introduced double-stranded DNA fragments are provided in sufficient quantity to modify RNA molecule(s) in the cell but do not persist after a contemplated period of time has passed or after one or more cell divisions.

Methods for direct DNA transfer in plants are known by the skilled artisan (see for instance Davey et al. Plant Mol Biol. 1989 Sep; 13(3):273-85.)

In other embodiments, an RNA polynucleotide encoding the RNA targeting protein is introduced into the plant cell, which is then translated and processed by the host cell generating the protein in sufficient quantity to modify the RNA molecule(s) cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122). Combinations of the different methods described above are also envisaged.

Delivery of RNA Targeting CRISPR Components to the Plant Cell

In particular embodiments, it is of interest to deliver one or more components of the RNA targeting CRISPR system directly to the plant cell. This is of interest, inter alia, for the generation of non-transgenic plants (see below). In particular embodiments, one or more of the RNA targeting components is prepared outside the plant or plant cell and delivered to the cell. For instance in particular embodiments, the RNA targeting protein is prepared in vitro prior to introduction to the plant cell. RNA targeting protein can be prepared by various methods known by one of skill in the art and include recombinant production. After expression, the RNA targeting protein is isolated, refolded if needed, purified and optionally treated to remove any purification tags, such as a His-tag. Once crude, partially purified, or more completely purified RNA targeting protein is obtained, the protein may be introduced to the plant cell.

In particular embodiments, the RNA targeting protein is mixed with guide RNA targeting the RNA of interest to form a pre-assembled ribonucleoprotein.

The individual components or pre-assembled ribonucleoprotein can be introduced into the plant cell via electroporation, by bombardment with RNA targeting-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. *Nature Biotechnology*, 2015; DOI: 10.1038/nbt.3389). These methods can be modified to achieve targeted modification of RNA molecules in the plants.

In particular embodiments, the RNA targeting CRISPR system components are introduced into the plant cells using particles. The components, either as protein or nucleic acid or in a combination thereof, can be uploaded onto or packaged in particles and applied to the plants (such as for instance described in WO 2008042156 and US 20130185823). In particular, embodiments of the invention comprise particles uploaded with or packed with DNA molecule(s) encoding the RNA targeting protein, DNA molecules encoding the guide RNA and/or isolated guide RNA as described in WO2015089419.

Further means of introducing one or more components of the RNA targeting CRISPR system to the plant cell is by using cell penetrating peptides (CPP). Accordingly, in particular, embodiments the invention comprises compositions comprising a cell penetrating peptide linked to an RNA targeting protein. In particular embodiments of the present invention, an RNA targeting protein and/or guide RNA(s) is coupled to one or more CPPs to effectively transport them inside plant protoplasts (Ramakrishna (2014, Genome Res. 2014 Jun; 24(6):1020-7 for Cas9 in human cells). In other embodiments, the RNA targeting gene and/or guide RNA(s) are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipathic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biomolecules with the target. Examples of CPP include amongst others: Tat, a nuclear transcriptional activator protein required for viral replication by HIV type1, penetratin, Kaposi fibroblast growth factor (FGF) signal peptide sequence, integrin β3 signal peptide sequence; polyarginine peptide Args sequence, Guanine rich-molecular transporters, sweet arrow peptide, etc. . . . .

Target RNA Envisaged for Plant, Algae or Fungal Applications

The target RNA, i.e. the RNA of interest, is the RNA to be targeted by the present invention leading to the recruitment to, and the binding of the RNA targeting protein at, the target site of interest on the target RNA. The target RNA may be any suitable form of RNA. This may include, in some embodiments, mRNA. In other embodiments, the target RNA may include transfer RNA (tRNA) or ribosomal RNA (rRNA). In other embodiments the target RNA may include interfering RNA (RNAi), microRNA (miRNA), microswitches, microzymes, satellite RNAs and RNA viruses. The target RNA may be located in the cytoplasm of the plant cell, or in the cell nucleus or in a plant cell organelle such as a mitochondrion, chloroplast or plastid.

In particular embodiments, the RNA targeting CRISPR system is used to cleave RINA or otherwise inhibit RNA expression.

Use of RNA Targeting CRISPR System for Modulating Plant Gene Expression Via RNA Modulation The RNA targeting protein may also be used, together with a suitable guide RNA, to target gene expression, via control of RNA processing. The control of RNA processing may include RNA processing reactions such as RNA splicing, including alternative splicing; viral replication (in particular of plant viruses, including viroids in plants and tRNA biosynthesis. The RNA targeting protein in combination with a suitable guide RNA may also be used to control RNA activation (RNAa). RNAa leads to the promotion of gene expression, so control of gene expression may be achieved that way through disruption or reduction of RNAa and thus less promotion of gene expression.

The RNA targeting effector protein of the invention can further be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX).

Examples of modulating RNA expression in plants, algae or fungi, as an alternative of targeted gene modification are described herein further.

Of particular interest is the regulated control of gene expression through regulated cleavage ofmRNA. This can be achieved by placing elements of the RNA targeting under the control of regulated promoters as described herein.

Use of the RNA Targeting CRISPR System to Restore the Functionality of tRNA Molecules.

Pring et al describe RNA editing in plant mitochondria and chloroplasts that alters mRNA sequences to code for different proteins than the DNA. (Plant Mol. Biol. (1993) 21 (6): 1163-1170. doi:10.1007/BF00023611). In particular embodiments of the invention, the elements of the RNA targeting CRISPR system specifically targetting mitochondrial and chloroplast mRNA can be introduced in a plant or plant cell to express different proteins in such plant cell organelles mimicking the processes occuring in vivo.

Use of the RNA Targeting CRISPR System as an Alternative to RNA Interference to Inhibit RNA Expression.

The RNA targeting CRISPR system has uses similar to RNA inhibition or RNA interference, thus can also be substituted for such methods. In particular embodiment, the methods of the present invention include the use of the RNA targeting CRISPR as a substitute for e.g. an interfering ribonucleic acid (such as an siRNA or shRNA or a dsRNA). Examples of inhibition of RNA expression in plants, algae or fungi as an alternative of targeted gene modification are described herein further.

Use of the RNA Tareting CRISPR System to Control RNA Interference.

Control over interfering RNA or miRNA may help reduce off-target effects (OTE) seen with those approaches by reducing the longevity of the interfering RNA or miRNA in vivo or in vitro. In particular embodiments, the target RNA may include interfering RNA, i.e. RNA involved in an RNA interference pathway, such as shRNA, siRNA and so forth. In other embodiments, the target RNA may include microRNA (miRNA) or double stranded RNA (dsRNA).

In other particular embodiments, if the RNA targeting protein and suitable guide RNA(s) are selectively expressed (for example spatially or temporally under the control of a regulated promoter, for example a tissue- or cell cycle-specific promoter and/or enhancer) this can be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The RNA targeting protein may be used to control or bind to molecules comprising or consisting of RNA, such as ribozymes, ribosomes or riboswitches. In embodiments of the invention, the guide RNA can recruit the RNA targeting protein to these molecules so that the RNA targeting protein is able to bind to them.

The RNA targeting CRISPR system of the invention can be applied in areas of in-planta RNAi technologies, without undue experimentation, from this disclosure, including insect pest management, plant disease management and management of herbicide resistance, as well as in plant assay and for other applications (see, for instance Kim et al., in Pesticide Biochemistry and Physiology (Impact Factor:

2.01). 01/2015; 120. DOI: 10.1016/j.pestbp.2015.01.002; Sharma et al. in Academic Journals (2015), Vol. 12(18) pp2303-2312); Green J. M, in Pest Management Science, Vol 70(9), pp 1351-1357), because the present application provides the foundation for informed engineering of the system.

Use of RNA Targeting CRISPR System to Modify Riboswitches and Control Metabolic Regulation in Plants, Algae and Fungi Riboswitches (also known as aptozymes) are regulatory segments of messenger RNA that bind small molecules and in turn regulate gene expression. This mechanism allows the cell to sense the intracellular concentration of these small molecules. A particular riboswitch typically regulates its adjacent gene by altering the transcription, the translation or the splicing of this gene. Thus, in particular embodiments of the present invention, control of riboswitch activity is envisaged through the use of the RNA targeting protein in combination with a suitable guide RNA to target the riboswitch. This may be through cleavage of, or binding to, the riboswitch. In particular embodiments, reduction of riboswitch activity is envisaged. Recently, a riboswitch that binds thiamin pyrophosphate (TPP) was characterized and found to regulate thiamin biosynthesis in plants and algae. Furthermore it appears that this element is an essential regulator of primary metabolism in plants (Bocobza and Aharoni, Plant J. 2014 August; 79(4):693-703. doi: 10.1111/tpj.12540. Epub 2014 Jun 17). TPP riboswitches are also found in certain fungi, such as in *Neurospora crassa*, where it controls alternative splicing to conditionally produce an Upstream Open Reading Frame (uORF), thereby affecting the expression of downstream genes (Cheah M T et al., (2007)Nature 447 (7143): 497-500. doi:10.1038/nature05769). The RNA targeting CRISPR system described herein may be used to manipulate the endogenous riboswitch activity in plants, algae or fungi and as such alter the expression of downstream genes controlled by it. In particular embodiments, the RNA targeting CRISP system may be used in assaying riboswitch function in vivo or in vitro and in studying its relevance for the metabolic network. In particular embodiments the RNA targeting CRISPR system may potentially be used for engineering of riboswitches as metabolite sensors in plants and platforms for gene control.

Use of RNA Targeting CRISPR System in RNAi Screens for Plants, Algae or Fungi

Identifying gene products whose knockdown is associated with phenotypic changes, biological pathways can be interrogated and the constituent parts identified, via RNAi screens. In particular embodiments of the invention, control may also be exerted over or during these screens by use of the Guide 29 or Guide 30 protein and suitable guide RNA described herein to remove or reduce the activity of the RNAi in the screen and thus reinstate the activity of the (previously interfered with) gene product (by removing or reducing the interference/repression).

Use of RNA Targeting Proteins for Visualization of RNA Molecules In Vivo and In Vitro In particular embodiments, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. As such, labelled elements of the RNA targeting system can be used as an alternative for efficient and adaptable system for in situ hybridization.

Further Applications of the RNA Targeting CRISPR System in Plants and Yeasts

Use of RNA Targeting CRISPR System in Biofuel Production

The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the RNA targeting CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488). Modifying Yeast for Biofuel Production In particular embodiments, the RNA targeting enzyme provided herein is used for bioethanol production by recombinant micro-organisms. For instance, RNA targeting enzymes can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the RNA targeting CRISPR complex is used to modify the expression of endogenous genes required for biofuel production and/or to modify endogenous genes why may interfere with the biofuel synthesis. More particularly the methods involve stimulating the expression in a micro-organism such as a yeast of one or more nucleotide sequence encoding enzymes involved in the conversion of pyruvate to ethanol or another product of interest. In particular embodiments the methods ensure the stimulation of expression of one or more enzymes which allows the micro-organism to degrade cellulose, such as a cellulase. In yet further embodiments, the RNA targeting CRISPR complex is used to suppress endogenous metabolic pathways which compete with the biofuel production pathway.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or over-express high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, the RNA targeting effetor protein and guide RNA are introduced in algae expressed using a vector that expresses the RNA targeting effector protein under the control of a constitutive promoter such as Hsp70A-Rbc S2 or Beta2-tubulin. Guide RNA will be delivered using a vector containing T7 promoter. Alternatively, in vitro transcribed guide RNA can be delivered to algae cells. Electroporation protocol follows standard recommended protocol from the GeneArt *Chlamydomonas* Engineering kit.

Particular Applications of the RNA Targeting Enzymes in Plants

In particular embodiments, present invention can be used as a therapy for virus removal in plant systems as it is able to cleave viral RNA. Previous studies in human systems have demonstrated the success of utilizing CRISPR in targeting the single strand RNA virus, hepatitis C (A. Price, et al., Proc. Natl. Acad. Sci, 2015). These methods may also be adapted for using the RNA targeting CRISPR system in plants.

Improved Plants

The present invention also provides plants and yeast cells obtainable and obtained by the methods provided herein. The improved plants obtained by the methods described herein may be useful in food or feed production through the modified expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or over-express high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In an embodiment of the invention, a Cas13b system is used to engineer pathogen resistant plants, for example by creating resistance against diseases caused by bacteria, fungi or viruses. In certain embodiments, pathogen resistance can be accomplished by engineering crops to produce a Cas13b system that wil be ingested by an insect pest, leading to mortality. In an embodiment of the invention, a Cas13b system is used to engineer abiotic stress tolerance. In another embodiment, a Cas13b system is used to engineer drought stress tolerance or salt stress tolerance, or cold or heat stress tolerance. Younis et al. 2014, Int. J. Biol. Sci. 10; 1150 reviewed potential targets of plant breeding methods, all of which are amenable to correction or improvement through use of a Cas13b system described herein. Some non-limiting target crops include *Arabidopsis Zea mays* is *thaliana, Oryza sativa* L, *Prunus domestica* L., *Gossypium hirsutum, Nicotiana rustica, Zea mays, Medicago sativa, Nicotiana benthamiana* and *Arabidopsis thaliana*

In an embodiment of the invention, a Cas13b system is used for management of crop pests. For example, a Cas13b system operable in a crop pest can be expressed from a plant host or transferred directly to the target, for example using a viral vector.

In an embodiment, the invention provides a method of efficiently producing homozygous organisms from a heterozygous non-human starting organism. In an embodiment, the invention is used in plant breeding. In another embodiment, the invention is used in animal breeding. In such embodiments, a homozygous organism such as a plant or animal is made by preventing or suppressing recombination by interfering with at least one target gene involved in double strand breaks, chromosome pairing and/or strand exchange.

Application of the CAS13B Proteins in Optimized Functional RNA Targeting Systems In an aspect the invention provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc. Applications of this system are described elsewhere herein.

According to one aspect the invention provides non-naturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the Cas13b enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas complex having at least three functional domains, at least one of which is associated with the RNA targeting enzyme and at least two of which are associated with the gRNA.

Accordingly, In an aspect the invention provides non-naturally occurring or engineered CRISPR-Cas complex composition comprising the guide RNA as herein-discussed and a CRISPR enzyme which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a Cas13b enzyme which has a diminished nuclease activity of at least 97%, or 100% as compared with the Cas13b enzyme not having the at least one mutation. In an aspect the invention provides a herein-discussed composition, wherein the Cas13b enzyme comprises two or more mutations. The mutations may be selected from mutations of one or more of the following amino acid residues: R116, H121, R1177, and H1182, such as for instance one or more of the following mutations: R116A, H121A, R1177A, and H1182A, according to *Bergeyella zoohelcum* Cas13b protein or a corresponding position in an ortholog.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains.

In an aspect the invention provides a herein-discussed composition, wherein the one or more functional domains associated with the adaptor protein or the RNA targeting enzume is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell.

In an aspect the invention provides a herein above-discussed composition wherein there is more than one gRNA, and the gRNAs target different sequences whereby when the composition is employed, there is multiplexing. In an aspect the invention provides a composition wherein there is more than one gRNA modified by the insertion of distinct RNA sequence(s) that bind to one or more adaptor proteins.

In an aspect the invention provides a herein-discussed composition wherein one or more adaptor proteins associated with one or more functional domains is present and bound to the distinct RNA sequence(s) inserted into the guide RNA(s).

In an aspect the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect the invention provides a method for modifying gene expression comprising the administration to a host or expression in a host in vivo of one or more of the compositions as herein-discussed.

In an aspect the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a lentivirus, an adenovirus, or an AAV.

In an aspect the invention provides a mammalian cell line of cells as herein-discussed, wherein the cell line is, optionally, a human cell line or a mouse cell line. In an aspect the invention provides a transgenic mammalian model, optionally a mouse, wherein the model has been transformed with a herein-discussed composition or is a progeny of said transformant.

In an aspect the invention provides a nucleic acid molecule(s) encoding guide RNA or the RNA targeting CRISPR-Cas complex or the composition as herein-discussed. In an aspect the invention provides a vector comprising: a nucleic acid molecule encoding a guide RNA (gRNA) comprising a guide sequence capable of hybridizing to a target sequence in a genomic locus of interest in a cell, wherein the direct repeat of the gRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect the invention provides vector(s) comprising nucleic acid molecule(s) encoding: non-naturally occurring or engineered CRISPR-Cas complex composition comprising the gRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect a vector can further comprise regulatory element(s) operable in a eukaryotic cell operably linked to the nucleic acid molecule encoding the guide RNA (gRNA) and/or the nucleic acid molecule encoding the RNA targeting enzyme and/or the optional nuclear localization sequence(s).

In one aspect, the invention provides a kit comprising one or more of the components described hereinabove. In some embodiments, the kit comprises a vector system as described above and instructions for using the kit.

In an aspect the invention provides a method of screening for gain of function (GOF) or loss of function (LOF) or for screening non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA includes either an activator or a repressor, and monitoring for GOF or LOF respectively as to those cells as to which the introduced gRNA includes an activator or as to those cells as to which the introduced gRNA includes a repressor.

In an aspect the invention provides a library of non-naturally occurring or engineered compositions, each comprising a RNA targeting CRISPR guide RNA (gRNA) comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs comprise a genome wide library comprising a plurality of RNA targeting guide RNAs (gRNAs). In an aspect the invention provides a library as herein-discussed, wherein the RNA targeting RNA targeting enzyme has a diminished nuclease activity of at least 97%, or 100% as compare with the RNA targeting enzyme not having the at least one mutation. In an aspect the invention provides a library as herein-discussed, wherein the adaptor protein is a fusion protein comprising the functional domain. In an aspect the invention provides a library as herein discussed, wherein the gRNA is not modified by the insertion of distinct RNA sequence(s) that bind to the one or two or more adaptor proteins. In an aspect the invention provides a library as herein discussed, wherein the one or two or more functional domains are associated with the RNA targeting enzyme. In an aspect the invention provides a library as herein discussed, wherein the cell population of cells is a population of eukaryotic cells. In an aspect the invention provides a library as herein discussed, wherein the eukaryotic cell is a mammalian cell, a plant cell or a yeast cell. In an aspect the invention provides a library as herein discussed, wherein the mammalian cell is a human cell. In an aspect the invention provides a library as herein discussed, wherein the population of cells is a population of embryonic stem (ES) cells.

In an aspect the invention provides a library as herein discussed, wherein the targeting is of about 100 or more RNA sequences. In an aspect the invention provides a library as herein discussed, wherein the targeting is of about 1000 or more RNA sequences. In an aspect the invention provides a library as herein discussed, wherein the targeting is of about 20,000 or more sequences. In an aspect the invention provides a library as herein discussed, wherein the targeting is of the entire transcriptome. In an aspect the invention provides a library as herein discussed, wherein the targeting is of a panel of target sequences focused on a relevant or desirable pathway. In an aspect the invention provides a library as herein discussed, wherein the pathway is an immune pathway. In an aspect the invention provides a library as herein discussed, wherein the pathway is a cell division pathway.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA interaction with the target RNA and the RNA targeting enzyme permitting engineering or alteration of guide RNA structure to optimize functionality of the entire RNA targeting CRISPR-Cas system. For example, the guide RNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the genomic level.

The skilled person will understand that modifications to the guide RNA which allow for binding of the adapter+ functional domain but not proper positioning of the adapter+ functional domain (e.g. due to steric hindrance within the three dimensial structure of the CRISPR complex) are modifications which are not intended. The one or more modified guide RNA may be modified, by introduction of a distinct RNA sequence(s) 5' of the direct repeat, within the direct repeat, or 3' of the guide sequence.

The modified guide RNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA selection) and concentration of gRNA (e.g. dependent on whether multiple gRNAs are used) may be advantageous for eliciting an improved effect.

Using the provided compositions, the person skilled in the art can advantageously and specifically target single or multiple loci with the same or different functional domains to elicit one or more genomic events. The compositions may be applied in a wide variety of methods for screening in libraries in cells and functional modeling in vivo (e.g. gene activation of lincRNA and indentification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR RNA targeting events. (See, e.g., Platt et al., Cell (2014), dx.doi.org/10.1016/j.cell.2014.09.014, or PCT patent publications cited herein, such as WO 2014/093622 (PCT/US2013/074667), which are not believed prior to the present invention or application). For example, the target cell comprises RNA targeting CRISRP enzyme conditionally or inducibly (e.g. in the form of Cre dependent constructs) and/or the adapter protein conditionally or inducibly and, on expression of a vector introduced into the target cell, the vector expresses that which induces or gives rise to the condition of s RNA targeting enzyme expression and/or adaptor expression in the target cell. By applying the teaching and compositions of the current invention with the known method of creating a CRISPR complex, inducible gene expression affected by functional domains are also an aspect of the current invention. Alternatively, the adaptor protein may be provided as a conditional or inducible element with a conditional or inducible s RNA targeting enzyme to provide an effective model for screening purposes, which advantageously only requires minimal design and administration of specific gRNAs for a broad number of applications.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting as described herein, and guide RNA (gRNA) wherein the gRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system. It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to an RNA target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence. For instance, cleavage of a target RNA polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA-RNA targeting specificity is the direct repeat sequence, which is to be appropriately linked to such guides. In particular, this implies that the direct repeat sequences are designed dependent on the origin of the RNA targeting enzyme. Thus, structural data available for validated dead guide sequences may be used for designing Cas13b specific equivalents. Structural similarity between, e.g., the orthologous nuclease domains HEPN of two or more Cas13b effector proteins may be used to transfer design equivalent dead guides. Thus, the dead guide herein may be appropriately modified in length and sequence to reflect such Cas13b specific equivalents, allowing for formation of the CRISPR complex and successful binding to the target RNA, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides allow to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The effectors, activators, repressors may be present in the form of fusion proteins.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 20-28 nt, downstream of a CRISPR motif can be extended in length at the 3' end.

General Provisions

In an aspect, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. The invention provides an efficient and adaptable system for in situ hybridization.

In embodiments of the invention the terms guide sequence and guide RNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), Clustal W, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long, such as 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

As used herein, "homology" refers to the degree of similarity between sequences of amino acids or nucleic acids. Sequence similarity searches can identify "homologous" proteins or genes by detecting statistically significant similarity that reflects common ancestry. BLAST, FASTA, SSEARCH, and other commonly used similarity searching programs produce accurate statistical estimates that can be used to reliably infer homology. A common rule of thumb is that two sequences are homologous if they are more than 30% identical over their entire lengths (much higher identities are seen by chance in short alignments).

By "homologous sequence" is meant, a nucleotide sequence or amino acid sequence that is shared by one or more polynucleotide or amino acid sequences, such as genes, gene transcripts and/or non-coding polynucleotides or proteins. Homologous sequences can also include conserved sequence regions shared by more than one polynucleotide or amino acid sequence. The invention provides for homologous sequences having less than 90% homology (e.g., 89%, 88%, 87%, 86%, 85%, 84%, 83%, 82%, 81%, 80%, 70%, 60%, 50%, 40%, 30%, 20% or less etc.).

Sequence identity may be determined by sequence comparison and alignment algorithms known in the art. To determine the percent identity of two nucleic acid sequences (or of two amino acid sequences), the sequences are aligned for optimal comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=#of identical positions/total #of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) Proc. Natl. Acad. Sci. USA 87:2264-68, modified as in Karlin and Altschul (1993) Proc. Natl. Acad. Sci. USA 90:5873-77. Such an algorithm is incorporated into the BLAST programs (version 2.0) of Altschul, et al. (1990) J. Mol. Biol. 215:403-10.

The alignment is optimized by introducing appropriate gaps and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. The alignment can also be optimized by introducing appropriate gaps and percent identity is determined over the entire length of the sequences aligned (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

By "conserved sequence region" is meant, a nucleotide or amino acid sequence of one or more regions in a polynucleotide or protein that does not vary significantly between generations or from one biological system, subject, or organism to another biological system, subject, or organism.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the R-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit P-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

As used herein, the term "crRNA" or "guide RNA" or "single guide RNA" or "sgRNA" or "one or more nucleic acid components" of a Group 29 or Group 30 effector protein loci comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), Clustal W, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide RNA may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence. In other embodiments, multiple DRs (such as dual DRs) may be present.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

The "tracrRNA" sequence or analogous terms includes any polynucleotide sequence that has sufficient complementarity with a crRNA sequence to hybridize. In general, degree of complementarity is with reference to the optimal alignment of the sca sequence and tracr sequence, along the length of the shorter of the two sequences. Optimal alignment may be determined by any suitable alignment algorithm, and may further account for secondary structures, such as self-complementarity within either the sca sequence or tracr sequence. In some embodiments, the degree of complementarity between the tracr sequence and sca sequence along the length of the shorter of the two when optimally aligned is about or more than about 25%, 30%, 40%, 50%, 60%, 70%, 80%, 90%, 95%, 97.5%, 99%, or higher. In certain embodiments, the tracrRNA may not be required. Indeed, as demonstrated herein, the group 29 effector protein from *Bergeyella zoohelcum* and orthologs thereof do not require a tracrRNA to ensure cleavage of an RNA target.

In further detail, the assay is as follows for a RNA target, provided that a PAM sequence is required to direct recognition. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the RNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12 h after transformation, all colonies formed by the test and control strains where harvested and plasmid RNA was isolated. Plasmid RNA was used as template for PCR amplification and subsequent deep sequencing. Representation of all PAMs in the untransfomed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM. In particular embodiments, the cleavage, such as the RNA cleavage is not PAM dependent. Indeed, as demonstrated herein, for the *Bergeyella zoohelcum* effector protein and its orthologs, RNA target cleavage appears to be PAM independent.

For minimization of toxicity and off-target effect, it will be important to control the concentration of nucleic acid-targeting guide RNA delivered. Optimal concentrations of nucleic acid-targeting guide RNA can be determined by testing different concentrations in a cellular or non-human eukaryote animal model and using deep sequencing the analyze the extent of modification at potential off-target genomic loci. The concentration that gives the highest level of on-target modification while minimizing the level of off-target modification should be chosen for in vivo delivery. The nucleic acid-targeting system is derived advantageously from a Type VI-B CRISPR system. In some embodiments, one or more elements of a nucleic acid-targeting system is derived from a particular organism comprising an endogenous RNA-targeting system. In particular embodiments, the Cas protein CRISPR system is a Group 29 or Group 30 effector protein system.

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. In particular embodiments, the homologue or orthologue of a Group 29 or Group 30 protein as referred to herein has a sequence homology or identity of at least 80%, more preferably at least 85%, even more preferably at least 90%, such as for instance at least 95% with said Group 29 or Group 30 effector protein. In a preferred embodiment, the Group 29 or Group 30 effector protein may be an ortholog of an organism of a genus which includes but is not limited to Bergeyella, *Prevotella, Porphyromonas, Bacteroides, Alistipes, Riemerella, Myroides, Flavobacterium, Capnocytophaga, Chryseobacterium*, Phaeodactylibacter, *Paludibacter* or *Psychroflexus*. Some methods of identifying orthologs of CRISPRsystem enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to Bergeyella, *Prevotella, Porphyromonas, Bacteroides, Alistipes, Riemerella, Myroides, Flavobacterium, Capnocytophaga, Chryseobacterium*, Phaeodactylibacter, *Paludibacter* or *Psychroflexus*. A chimeric enzyme can comprise a first fragment and a second fragment, and the fragments can be of CRISPR enzyme orthologs of organisms of genuses herein mentioned or of species herein mentioned; advantageously the fragments are from CRISPR enzyme orthologs of different species.

In embodiments, the Type VI-B RNA-targeting effector proteins referred to herein also encompasses a functional variant of the effector protein or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. In an embodiment, nucleic acid molecule(s) encoding the Group 29 or Group 30 RNA-targeting effector proteins, or an ortholog or homolog thereof, may be codon-optimized for expression in an eukaryotic cell. A eukaryote can be as herein discussed. Nucleic acid molecule(s) can be engineered or non-naturally occurring.

In an embodiment, the Type VI-B RNA-targeting (e.g. Group 29 or Group 30) effector protein or an ortholog or homolog thereof, may comprise one or more mutations. The mutations may be artificially introduced mutations and may include but are not limited to one or more mutations in a catalytic domain. Examples of catalytic domains with reference to an effector enzyme may include but are not limited to RuvC I, RuvC II, RuvC III, HNH domains, and HEPN domains. In particular embodiments, the one or more mutations are introduced ino one or more of the HEPN domains.

In an embodiment, the Group 29 or Group 30 protein or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In some embodiments, the unmodified nucleic acid-targeting effector protein may have cleavage activity. In some embodiments, the RNA-targeting effector protein may direct cleavage of one or both nucleic acid (DNA or RNA) strands at the location of or near a target sequence, such as within the target sequence and/or within the complement of the target sequence or at sequences associated with the target sequence. In some embodiments, the nucleic acid-targeting CRISPR protein may direct cleavage of one or both DNA or RNA strands within about 1, 2, 3, 4, 5, 6, 7, 8, 9, 10, 15, 20, 25, 50, 100, 200, 500, or more base pairs from the first or last nucleotide of a target sequence. In some embodiments, the nucleic acid-targeting CRISPR protein may direct more than one cleavage (such as one, two three, four, five, or more cleavages) of one or both DNA or RNA strands within the target sequence and/or within the complement of the target sequence or at sequences associated with the target sequence and/or within about 1, 2, 3, 4, 5, 6, 7, 8, 9, 10, 15, 20, 25, 50, 100, 200, 500, or more base pairs from the first or last nucleotide of a target sequence. In some embodiments, the cleavage may be blunt, i.e., generating blunt ends. In some embodiments, the cleavage may be staggered, i.e., generating sticky ends. In some embodiments, the cleavage may be a staggered cut with a 5' overhang, e.g., a 5' overhang of 1 to 5 nucleotides. In some embodiments, the cleavage may be a staggered cut with a 3' overhang, e.g., a 3' overhang of 1 to 5 nucleotides. In some embodiments, a vector encodes a nucleic acid-targeting Cas protein that may be mutated with respect to a corresponding wild-type enzyme such that the mutated nucleic acid-targeting Cas protein lacks the ability to cleave one or both DNA or RNA strands of a target polynucleotide containing a target sequence. As a further example, two or more catalytic domains of Cas (RuvC I, RuvC II, and RuvC III or the HNH domain, or HEPN domain) may be mutated to produce a mutated Cas substantially lacking all RNA cleavage activity. As described herein, corresponding catalytic domains of the effector protein may also be mutated to produce a mutated Group 29 or Group 30 effector protein lacking all nucleic acid cleavage activity or having substantially reduced nucleic acid cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from previously described enzyme systems. By derived, Applicants mean that the derived enzyme is largely based, in the sense of having a high degree of sequence homology with, a wildtype enzyme, but that it has been mutated (modified) in some way as known in the art or as described herein.

Again, it will be appreciated that the terms Cas and CRISPR enzyme and CRISPR protein and Cas protein are generally used interchangeably and at all points of reference herein refer by analogy to novel CRISPR effector proteins further described in this application, unless otherwise apparent, such as by specific reference to Cas9. As mentioned above, many of the residue numberings used herein refer to the effector protein from Group 29 or Group 30 CRISPR locus. However, it will be appreciated that this invention includes many more effector proteins from other species of microbes. In certain embodiments, Cas may be constitutively present or inducibly present or conditionally present or administered or delivered. Cas optimization may be used to enhance function or to develop new functions, one can generate chimeric Cas proteins. And Cas may be used as a generic nucleic acid binding protein.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both DNA or RNA strands in or near (e.g., within 1, 2, 3, 4, 5, 6, 7, 8, 9, 10, 20, 50, or more base pairs from) the target sequence. As used herein the term "sequence(s) associated with a target locus of interest" refers to sequences near the vicinity of the target sequence (e.g. within 1, 2, 3, 4, 5, 6, 7, 8, 9, 10, 20, 50, or more base pairs from the target sequence, wherein the target sequence is comprised within a target locus of interest).

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., Group 29 or Group 30) is within the ambit of the skilled artisan. Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid.

In some embodiments, a vector encodes a nucleic acid-targeting effector protein such as the Group 29 or Group 30 effectors as described herein, or an ortholog or homolog thereof comprising one or more nuclear localization sequences (NLSs), such as about or more than about 1, 2, 3, 4, 5, 6, 7, 8, 9, 10, or more NLSs. In some embodiments, the RNA-targeting effector protein comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 1); the NLS from nucleoplasmin (e.g., the nucleoplasmin bipartite NLS with the sequence KRPAATKKAGQAKKKK (SEQ ID NO: 2); the c-myc NLS having the amino acid sequence PAAKRVKLD (SEQ ID NO: 3) or RQRRNELKRSP (SEQ ID NO: 4); the hRNPA1 M9 NLS having the sequence NQSSNFGPMKGGNFGGRSSGPYGGGGQYFAK-PRNQGGY (SEQ ID NO: 5; the sequence RMRIZFKNKGKDTAELRRRRVEVSVELRKAKKD-EQILKRRNV (SEQ ID NO: 6) of the IBB domain from importin-alpha; the sequences VSRKRPRP (SEQ ID NO: 7) and PPKKARED (SEQ ID NO: 8) of the myoma T protein; the sequence POPKKKPL (SEQ ID NO: 9) of human p53; the sequence SALIKKKKKMAP (SEQ ID NO: 10) of mouse c-abl IV; the sequences DRLRR (SEQ ID NO: 12) and PKQKKRK (SEQ ID NO: 12) of the influenza virus NS1; the sequence RKLKKKIKKL (SEQ ID NO: 13) of the Hepatitis virus delta antigen; the sequence REKKKFLKRR (SEQ ID NO: 14) of the mouse Mx1 protein; the sequence KRKGDEVDGVDEVAKKKSKK (SEQ ID NO: 15) of the human poly(ADP-ribose) polymerase; and the sequence RKCLQAGMNLEARKTKK (SEQ ID NO: 16) of the steroid hormone receptors (human) glucocorticoid. In general, the one or more NLSs are of sufficient strength to drive accumulation of the DNA/RNA-targeting Cas protein in a detectable amount in the nucleus of a eukaryotic cell. In general, strength of nuclear localization activity may derive from the number of NLSs in the nucleic acid-targeting effector protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for DNA or RNA cleavage or mutation at the target sequence, or assay for altered gene expression activity affected by DNA or RNA-targeting complex formation and/or DNA or RNA-targeting Cas protein activity), as compared to a control not exposed to the nucleic acid-targeting Cas protein or nucleic acid-targeting complex, or exposed to a nucleic acid-targeting Cas protein lacking the one or more NLSs. In preferred embodiments of the herein described Group 29 or Group 30 effector protein complexes and systems the codon optimized Cpf1 effector proteins comprise an NLS attached to the C-terminal of the protein.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector proteinor has cells containing nucleic acid-targeting effector protein, such as by way of prior administration thereto of a vector or vectors that code for and express in vivo nucleic acid-targeting effector protein. Alternatively, two or more of the elements expressed from the same or different regulatory elements, may be combined in a single vector, with one or more additional vectors providing any components of the nucleic acid-targeting system not included in the first vector. Nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, particles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. In some embodiments, a vector comprises an insertion site upstream of a tracr mate sequence, and optionally downstream of a regulatory element operably linked to the tracr mate sequence, such that following insertion of a guide sequence into the insertion site and upon expression the guide sequence directs sequence-specific binding of a nucleic acid-targeting complex to a target sequence in a eukaryotic cell. In some embodiments, a vector comprises two or more insertion sites, so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a nucleic acid-targeting effector protein. Nucleic acid-targeting effector protein or nucleic acid-targeting guide RNA or RNA(s) can be delivered separately; and advantageously at least one of these is delivered via a particle or particle complex. Nucleic acid-targeting effector protein mRNA can be delivered prior to the nucleic acid-targeting guide RNA to give time for nucleic acid-targeting effector protein to be expressed. Nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome modification.

In one aspect, the invention provides methods for using one or more elements of a nucleic acid-targeting system. The nucleic acid-targeting complex of the invention provides an effective means for modifying a target DNA or RNA single or double stranded, linear or super-coiled). The nucleic acid-targeting complex of the invention has a wide variety of utility including modifying (e.g., deleting, inserting, translocating, inactivating, activating) a target DNA or RNA in a multiplicity of cell types. As such the nucleic acid-targeting complex of the invention has a broad spectrum of applications in, e.g., gene therapy, drug screening, disease diagnosis, and prognosis. An exemplary nucleic acid-targeting complex comprises a DNA or RNA-targeting effector protein complexed with a guide RNA hybridized to a target sequence within the target locus of interest.

In other embodiments, this invention provides a method of modifying expression of a RNA in a eukaryotic cell. The method comprises increasing or decreasing expression of a target polynucleotide by using a nucleic acid-targeting complex that binds to the RNA (e.g., mRNA or pre-mRNA). In some methods, a target RNA can be inactivated to effect the modification of the expression in a cell. For example, upon the binding of a RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA). Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissues compared with tissues or cells of a non disease control. It may be a RNA transcribed from a gene that becomes expressed at an abnormally high level; it may be a RNA transcribed from a gene that becomes expressed at an abnormally low level, where the altered expression correlates with the occurrence and/or progression of the disease. A disease-associated RNA also refers to a RNA transcribed from a gene possessing mutation(s) or genetic variation that is directly responsible or is in linkage disequilibrium with a gene(s) that is responsible for the etiology of a disease. The translated products may be known or unknown, and may be at a normal or abnormal level. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

In some embodiments, the method may comprise allowing a nucleic acid-targeting complex to bind to the target DNA or RNA to effect cleavage of said target DNA or RNA thereby modifying the target DNA or RNA, wherein the nucleic acid-targeting complex comprises a nucleic acid-targeting effector protein complexed with a guide RNA hybridized to a target sequence within said target DNA or RNA. In one aspect, the invention provides a method of modifying expression of DNA or RNA in a eukaryotic cell. In some embodiments, the method comprises allowing a nucleic acid-targeting complex to bind to the DNA or RNA such that said binding results in increased or decreased expression of said DNA or RNA; wherein the nucleic acid-targeting complex comprises a nucleic acid-targeting effector protein complexed with a guide RNA. Similar considerations and conditions apply as above for methods of modifying a target DNA or RNA. In fact, these sampling, culturing and re-introduction options apply across the aspects of the present invention. In one aspect, the invention provides for methods of modifying a target DNA or RNA in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

Indeed, in any aspect of the invention, the nucleic acid-targeting complex may comprise a nucleic acid-targeting effector protein complexed with a guide RNA hybridized to a target sequence.

The invention relates to the engineering and optimization of systems, methods and compositions used for the control of gene expression involving DNA or RNA sequence targeting, that relate to the nucleic acid-targeting system and components thereof An advantage of the present methods is that the CRISPR system minimizes or avoids off-target binding and its resulting side effects. This is achieved using systems arranged to have a high degree of sequence specificity for the target DNA or RNA.

In relation to a nucleic acid-targeting complex or system preferably, the tracr sequence has one or more hairpins and is 30 or more nucleotides in length, 40 or more nucleotides in length, or 50 or more nucleotides in length; the crRNA sequence is between 10 to 30 nucleotides in length, the nucleic acid-targeting effector protein is a Group 29 or Group 30 effector protein.

The use of two different aptamers (each associated with a distinct nucleic acid-targeting guide RNAs) allows an activator-adaptor protein fusion and a repressor-adaptor protein fusion to be used, with different nucleic acid-targeting guide RNAs, to activate expression of one DNA or RNA, whilst repressing another. They, along with their different guide RNAs can be administered together, or substantially together, in a multiplexed approach. A large number of such modified nucleic acid-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the nucleic acid-targeting effector protein-guide RNA complex as a whole may be associated with two or more functional domains. For example, there may be two or more functional domains associated with the nucleic acid-targeting effector protein, or there may be two or more functional domains associated with the guide RNA (via one or more adaptor proteins), or there may be one or more functional domains associated with the nucleic acid-targeting effector protein and one or more functional domains associated with the guide RNA (via one or more adaptor proteins).

The fusion between the adaptor protein and the activator or repressor may include a linker. For example, GlySer linkers GGGS can be used. They can be used in repeats of 3 ((GGGGS)$_3$) (SEQ ID No: 17) or 6, 9 or even 12 or more, to provide suitable lengths, as required. Linkers can be used between the guide RNAs and the functional domain (activator or repressor), or between the nucleic acid-targeting effector protein and the functional domain (activator or repressor). The linkers the user to engineer appropriate amounts of "mechanical flexibility".

The invention comprehends a nucleic acid-targeting complex comprising a nucleic acid-targeting effector protein and a guide RNA, wherein the nucleic acid-targeting effector protein comprises at least one mutation, such that the nucleic acid-targeting Cas protein has no more than 5% of the activity of the nucleic acid-targeting Cas protein not having the at least one mutation and, optionally, at least one or more nuclear localization sequences; the guide RNA comprises a guide sequence capable of hybridizing to a target sequence in a RNA of interest in a cell; and wherein: the nucleic acid-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the nucleic acid-targeting effector protein is associated with one or more functional domains and at least one loop of the guide RNA is modified by the insertion of distinct RNA sequence(s) that bind to one or more adaptor proteins, and wherein the adaptor protein is associated with one or more functional domains.

Group 29 or Group 30 Effector Protein Complexes can Deliver Functional Effectors Unlike CRISPR-Cas-mediated gene knockout, which permanently eliminates expression by mutating the gene at the DNA level, CRISPR-Cas knockdown allows for temporary reduction of gene expression through the use of artificial transcription factors. Mutating key residues in one or both DNA cleavage domains of the Group 29 or Group 30 protein results in the generation of a catalytically inactive Group 29 or Group 30 protein. A catalytically inactive Group 29 or Group 30 complexes with a guide RNA and localizes to the DNA sequence specified by that guide RNA's targeting domain, however, it does not cleave the target DNA. Fusion of the inactive Group 29 or Group 30 protein to an effector domain, e.g., a transcription repression domain, enables recruitment of the effector to any DNA site specified by the guide RNA. In certain embodiments, Group 29 or Group 30 may be fused to a transcriptional repression domain and recruited to the promoter region of a gene. Especially for gene repression, it is contemplated herein that blocking the binding site of an endogenous transcription factor would aid in downregulating gene expression. In another embodiment, an inactive Group 29 or Group 30 can be fused to a chromatin modifying protein. Altering chromatin status can result in decreased expression of the target gene.

Optimized Functional RNA Targeting Systems

In an aspect the invention thus provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc. According to one aspect the invention provides non-naturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of at least the group29 enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas complex having at least three functional domains, at least one of which is associated with the RNA targeting enzyme and at least two of which are associated with the gRNA.

In particular embodiments, the effector protein is a group29 effector protein from Bergeyella zoohelcum ATCC 43767 and the functional domain is linked to the guide RNA through a linker inserted after the minimal direct repeat. Indeed, it has been established that at least some of the group29 effector proteins comprise both long (about 87nt) and short (about 36 nt) direct repeat sequences. Accordingly this implies that a non-functional sequence can be inserted 3' of the short direct repeat sequence while maintaining a functional guide.

Accordingly, In an aspect the invention provides non-naturally occurring or engineered CRISPR-Cas complex composition comprising the guide RNA as herein-discussed and a CRISPR enzyme which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a group29 enzyme which has a diminished nuclease activity of at least 97%, or 100% as compared with the group29 enzyme not having the at least one mutation. In an aspect the invention provides a herein-discussed composition, wherein the group29 enzyme comprises two or more mutations. The mutations may be selected from R116A, H121A, R1177A, and H1182A, according to Bergeyella zoohelcum ATCC 43767 group29 protein or a corresponding position in an ortholog.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains. In particular embodiments, the one or more functional domains are attached to the C-terminal end of the RNA effector protein, such as the C-terminal end of the group29 effector protein from Bergeyella zoohelcum ATCC 43767.

In an aspect the invention provides a herein-discussed composition, wherein the one or more functional domains associated with the adaptor protein or the RNA targeting enzume is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility. Envisaged applications are detailed herein below.

In an aspect the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, QP, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell.

In an aspect the invention provides a herein above-discussed composition wherein there is more than one gRNA, and the gRNAs target different sequences whereby when the composition is employed, there is multiplexing. In an aspect the invention provides a composition wherein there is more than one gRNA modified by the insertion of distinct RNA sequence(s) that bind to one or more adaptor proteins.

In an aspect the invention provides a herein-discussed composition wherein one or more adaptor proteins associated with one or more functional domains is present and bound to the distinct RNA sequence(s) inserted into the guide RNA(s).

In an aspect the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect the invention provides a method for modifying gene expression comprising the administration to a host or expression in a host in vivo of one or more of the compositions as herein-discussed.

In an aspect the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a lentivirus, an adenovirus, or an AAV.

In an aspect the invention provides a mammalian cell line of cells as herein-discussed, wherein the cell line is, optionally, a human cell line or a mouse cell line. In an aspect the invention provides a transgenic mammalian model, optionally a mouse, wherein the model has been transformed with a herein-discussed composition or is a progeny of said transformant.

In an aspect the invention provides a nucleic acid molecule(s) encoding guide RNA or the RNA targeting CRISPR-Cas complex or the composition as herein-discussed. In an aspect the invention provides a vector comprising: a nucleic acid molecule encoding a guide RNA (gRNA) comprising a guide sequence capable of hybridizing to a target sequence in a genomic locus of interest in a cell, wherein the direct repeat of the gRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect the invention provides vector(s) comprising nucleic acid molecule(s) encoding: non-naturally occurring or engineered CRISPR-Cas complex composition comprising the gRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect a vector can further comprise regulatory element(s) operable in a eukaryotic cell operably linked to the nucleic acid molecule encoding the guide RNA (gRNA) and/or the nucleic acid molecule encoding the RNA targeting enzyme and/or the optional nuclear localization sequence(s).

In one aspect, the invention provides a kit comprising one or more of the components described hereinabove. In some embodiments, the kit comprises a vector system as described above and instructions for using the kit.

In an aspect the invention provides a method of screening for gain of function (GOF) or loss of function (LOF) or for screen non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA includes either an activator or a repressor, and monitoring for GOF or LOF respectively as to those cells as to which the introduced gRNA includes an activator or as to those cells as to which the introduced gRNA includes a repressor.

In an aspect the invention provides a library of non-naturally occurring or engineered compositions, each comprising a RNA targeting CRISPR guide RNA (gRNA) comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs comprise a genome wide library comprising a plurality of RNA targeting guide RNAs (gRNAs). In an aspect the invention provides a library as herein-discussed, wherein the RNA targeting RNA targeting enzyme has a diminished nuclease activity of at least 97%, or 100% as compare with the RNA targeting enzyme not having the at least one mutation. In an aspect the invention provides a library as herein-discussed, wherein the adaptor protein is a fusion protein comprising the functional domain.

In an aspect the invention provides a library as herein discussed, wherein the gRNA is not modified by the insertion of distinct RNA sequence(s) that bind to the one or two or more adaptor proteins. In an aspect the invention provides a library as herein discussed, wherein the one or two or more functional domains are associated with the RNA targeting enzyme. In an aspect the invention provides a library as herein discussed, wherein the cell population of cells is a population of eukaryotic cells. In an aspect the invention provides a library as herein discussed, wherein the eukaryotic cell is a mammalian cell, a plant cell or a yeast cell. In an aspect the invention provides a library as herein discussed, wherein the mammalian cell is a human cell. In an aspect the invention provides a library as herein discussed, wherein the population of cells is a population of embryonic stem (ES) cells.

In an aspect the invention provides a library as herein discussed, wherein the targeting is of about 100 or more RNA sequences. In an aspect the invention provides a library as herein discussed, wherein the targeting is of about 1000 or more RNA sequences. In an aspect the invention provides a library as herein discussed, wherein the targeting is of about 20,000 or more sequences. In an aspect the invention provides a library as herein discussed, wherein the targeting is of the entire transcriptome. In an aspect the invention provides a library as herein discussed, wherein the targeting is of a panel of target sequences focused on a relevant or desirable pathway. In an aspect the invention provides a library as herein discussed, wherein the pathway is an immune pathway. In an aspect the invention provides a library as herein discussed, wherein the pathway is a cell division pathway.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA interaction with the target RNA and the RNA targeting enzyme permitting engineering or alteration of guide RNA structure to optimize functionality of the entire RNA targeting CRISPR-Cas system. For example, the guide RNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the genomic level.

The skilled person will understand that modifications to the guide RNA which allow for binding of the adapter+ functional domain but not proper positioning of the adapter+ functional domain (e.g. due to steric hindrance within the three dimensial structure of the CRISPR complex) are modifications which are not intended. The one or more modified guide RNA may be modified, by introduction of a distinct RNA sequence(s) 5' of the direct repeat, within the direct repeat, or 3' of the guide sequence.

The modified guide RNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA selection) and concentration of gRNA (e.g. dependent on whether multiple gRNAs are used) may be advantageous for eliciting an improved effect.

Using the provided compositions, the person skilled in the art can advantageously and specifically target single or multiple loci with the same or different functional domains to elicit one or more genomic events. The compositions may be applied in a wide variety of methods for screening in libraries in cells and functional modeling in vivo (e.g. gene activation of lincRNA and indentification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR RNA targeting events. (See, e.g., Platt et al., Cell (2014), dx.doi.org/10.1016/j.cell.2014.09.014, or PCT patent publications cited herein, such as WO 2014/093622 (PCT/US2013/074667), which are not believed prior to the present invention or application). For example, the target cell comprises RNA targeting CRISRP enzyme conditionally or inducibly (e.g. in the form of Cre dependent constructs) and/or the adapter protein conditionally or inducibly and, on expression of a vector introduced into the target cell, the vector expresses that which induces or gives rise to the condition of s RNA targeting enzyme expression and/or adaptor expression in the target cell. By applying the teaching and compositions of the current invention with the known method of creating a CRISPR complex, inducible gene expression affected by functional domains are also an aspect of the current invention. Alternatively, the adaptor protein may be provided as a conditional or inducible element with a conditional or inducible s RNA targeting enzyme to provide an effective model for screening purposes, which advantageously only requires minimal design and administration of specific gRNAs for a broad number of applications.

In an embodiment, a guide RNA molecule can be targeted to a known transcription response elements (e.g., promoters, enhancers, etc.), a known upstream activating sequences, and/or sequences of unknown or known function that are suspected of being able to control expression of the target DNA.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

Further examples of applications of this system are described elsewhere herein.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting as described herein, and guide RNA (gRNA) wherein the gRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system. It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to an RNA target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence. For instance, cleavage of a target RNA polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA-RNA targeting specificity is the direct repeat sequence, which is to be appropriately linked to such guides. In particular, this implies that the direct repeat sequences are designed dependent on the origin of the RNA targeting enzyme. Thus, structural data available for validated dead guide sequences may be used for designing group29 specific equivalents. Structural similarity between, e.g., the orthologous nuclease domains HEPN of two or more group29 effector proteins may be used to transfer design equivalent dead guides. Thus, the dead guide herein may be appropriately modified in length and sequence to reflect such group29 specific equivalents, allowing for formation of the CRISPR complex and successful binding to the target RNA, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides allow to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The effectors, activators, repressors may be present in the form of fusion proteins.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 36 nt, downstream of a CRISPR motif can be extended in length at the 3' end.

Delivery of the Group 29 or Group 30 Effector Protein Complex or Components Thereof Through this disclosure and the knowledge in the art, TALEs, CRISPR-Cas systems, or components thereof or nucleic acid molecules thereof (including, for instance HDR template) or nucleic acid molecules encoding or providing components thereof may be delivered by a delivery system herein described both generally and in detail.

Vector delivery, e.g., plasmid, viral delivery: The CRISPR enzyme, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1 \times 10^5$ particles (also referred to as particle units, pu) of adenoviral vector. In an embodiment herein, the dose preferably is at least about $1 \times 10^6$ particles (for example, about $1 \times 10^6$-$1 \times 10^{12}$ particles), more preferably at least about $1 \times 10^7$ particles, more preferably at least about $1 \times 10^8$ particles (e.g., about $1 \times 10^8$-$1 \times 10^{11}$ particles or about $1 \times 10^8$-$1 \times 10^{12}$ particles), and most preferably at least about $1 \times 10^0$ particles (e.g., about $1 \times 10^9$-$1 \times 10^{10}$ particles or about $1 \times 10^9$-$1 \times 10^{12}$ particles), or even at least about $1 \times 10^{10}$ particles (e.g., about $1 \times 10^{10}$-$1 \times 10^{12}$ particles) of the adenoviral vector. Alternatively, the dose comprises no more than about $1 \times 10^{14}$ particles, preferably no more than about $1 \times 10^{13}$ particles, even more preferably no more than about $1 \times 10^{12}$ particles, even more preferably no more than about $1 \times 10^{11}$ particles, and most preferably no more than about $1 \times 10^{10}$ particles (e.g., no more than about $1 \times 10^9$ articles). Thus, the dose may contain a single dose of adenoviral vector with, for example, about $1 \times 10^6$ particle units (pu), about $2 \times 10^6$ pu, about 4×10⁶ pu, about 1×10⁷ pu, about 2×10⁷ pu, about 4×10⁷ pu, about 1×10⁸ pu, about 2×10⁸ pu, about 4×10⁸ pu, about 1×10⁹ pu, about 2×10⁹ pu, about 4×10⁹ pu, about 1×10¹⁰ pu, about 2×10¹⁰ pu, about 4×10¹⁰ pu, about 1×10¹¹ pu, about 2×10¹¹ pu, about 4×10¹¹ pu, about 1×10¹² pu, about 2×10¹² pu, or about 4×10¹² pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about 1×10¹⁰ to about 1×10¹⁰ functional AAV/ml solution. The dosage may be adjusted to balance the therapeutic benefit against any side effects. In an embodiment herein, the AAV dose is generally in the range of concentrations of from about 1×10⁵ to 1×10⁵⁰ genomes AAV, from about 1×10⁸ to 1×10²⁰ genomes AAV, from about 1×10¹⁰ to about 1×10¹⁶ genomes, or about 1×10¹¹ to about 1×10¹⁶ genomes AAV. A human dosage may be about 1×10¹³ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 µg to about 10 µg per 70 kg individual. Plasmids of the invention will generally comprise (i) a promoter; (ii) a sequence encoding an nucleic acid-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver nucleic acid-targeting Cas protein and guide RNA (and, for instance, HR repair template) into cells using liposomes or particles. Thus delivery of the nucleic acid-targeting Cas protein/CRISPR enzyme, such as a CasCas9 and/or delivery of the guide RNAs of the invention may be in RNA form and via microvesicles, liposomes or particles. For example, Cas mRNA and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (a-tocopherol) may be conjugated with nucleic acid-targeting Cas protein and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free Toc-siBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of nucleic acid-targeting effector protein conjugated to a-tocopherol and co-administered with HDL targeted to the brain may be contemplated for humans in the present invention, for example, about 3 nmol to about 3 pmol of nucleic acid-targeting effector protein targeted to the brain may be contemplated. Zou et al. ((HUMAN GENE THERAPY 22:465-475 (April 2011)) describes a method of lentiviral-mediated delivery of short-hairpin RNAs targeting PKC7 for in vivo gene silencing in the spinal cord of rats. Zou et al. administered about 10 µl of a recombinant lentivirus having a titer of 1×10' transducing units (TU)/ml by an intrathecal catheter. A similar dosage of nucleic acid-targeting effector protein expressed in a lentiviral vector targeted to the brain may be contemplated for humans in the present invention, for example, about 10-50 ml of nucleic acid-targeting effector protein targeted to the brain in a lentivirus having a titer of 1×10' transducing units (TU)/ml may be contemplated.

In terms of local delivery to the brain, this can be achieved in various ways. For instance, material can be delivered intrastriatally e.g., by injection. Injection can be performed stereotactically via a craniotomy.

Packaning and Promoters Generally

Ways to package nucleic acid-targeting effector protein (such as Group 29 or Group 30 proteins) coding nucleic acid molecules, e.g., DNA, into vectors, e.g., viral vectors, to mediate genome modification in vivo include:

To achieve RNA cleavage (and hence knockdown):
Single virus vector:
Vector containing two or more expression cassettes:
Promoter-nucleic acid-targeting effector protein coding nucleic acid molecule-terminator
Promoter-guide RNA1-terminator
Promoter-guide RNA(N)-terminator (up to size limit of vector)
Double virus vector:
Vector 1 containing one expression cassette for driving the expression of nucleic acid-targeting effector protein (such as a Group 29 or Group 30)
Promoter-nucleic acid-targeting effector protein coding nucleic acid molecule-terminator
Vector 2 containing one more expression cassettes for driving the expression of one or more guide RNAs
Promoter-guide RNA1-terminator
Promoter-guide RNA1 (N)-terminator (up to size limit of vector)

The promoter used to drive nucleic acid-targeting effector protein coding nucleic acid molecule expression can include:
AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of nucleic acid-targeting effector protein.
For ubiquitous expression, can use promoters: CMV, CAG, CBh, PGK, SV40, Ferritin heavy or light chains, etc.
For brain or other CNS expression, can use promoters: Synapsin I for all neurons, CaMKIIalpha for excitatory neurons, GAD67 or GAD65 or VGAT for GABAergic neurons, etc.
For liver expression, can use Albumin promoter.
For lung expression, can use SP-B.
For endothelial cells, can use ICAM.
For hematopoietic cells can use IFNbeta or CD45.
For Osteoblasts can use OG-2.
The promoter used to drive guide RNA can include:
Pol III promoters such as U6 or H1
Use of Pol II promoter and intronic cassettes to express guide RNA Adeno Associated Virus (AAV)

Nucleic acid-targeting effector protein (such as a Group 29 or Group 30 effector protein) and one or more guide RNA can be delivered using adeno associated virus (AAV), lentivirus, adenovirus or other plasmid or viral vector types, in particular, using formulations and doses from, for example, U.S. Pat. Nos. 8,454,972 (formulations, doses for adenovirus), 8,404,658 (formulations, doses for AAV) and 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of nucleic acid-targeting effector protein (such as a Group 29 or Group 30 effector protein) can be driven by a cell-type specific promoter. For example, liver-specific expression might use the Albumin promoter and neuron-specific expression (e.g., for targeting CNS disorders) might use the Synapsin I promoter.

In terms of in vivo delivery, AAV is advantageous over other viral vectors for a couple of reasons:
Low toxicity (this may be due to the purification method not requiring ultra centrifugation of cell particles that can activate the immune response) and
Low probability of causing insertional mutagenesis because it doesn't integrate into the host genome.

AAV has a packaging limit of 4.5 or 4.75 Kb. This means that nucleic acid-targeting effector protein (such as a Group 29 or Group 30 effector protein) as well as a promoter and transcription terminator have to be all fit into the same viral vector. Therefore embodiments of the invention include utilizing homologs of nucleic acid-targeting effector protein (such as a Group 29 or Group 30 effector protein) that are shorter.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
| --- | --- | --- | --- | --- | --- | --- | --- | --- |
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |

-continued

| Cell Line | AAV-1 | AAV-2 | AAV-3 | AAV-4 | AAV-5 | AAV-6 | AAV-8 | AAV-9 |
|---|---|---|---|---|---|---|---|---|
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 µg of lentiviral transfer plasmid (pCasES10) and the following packaging plasmids: 5 µg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4° C. They were then aliquotted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine inffctious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the nucleic acid-targeting system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used and/or adapted to the nucleic acid-targeting system of the present invention. A minimum of $2.5 \times 10^6$ CD34+ cells per kilogram patient weight may be collected and prestimulated for 16 to 20 hours in X-VIVO 15 medium (Lonza) containing 2 µmol/L-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm² tissue culture flasks coated with fibronectin (25 mg/cm²) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

RNA Delivery

RNA delivery: The nucleic acid-targeting Cas protein, and/or guide RNA, can also be delivered in the form of RNA. nucleic acid-targeting Cas protein (such as a Group 29 or Group 30 effector protein) mRNA can be generated using in vitro transcription. For example, nucleic acid-targeting effector protein (such as a Group 29 or Group 30 effector protein) mRNA can be synthesized using a PCR cassette containing the following elements: T7_promoter-kozak sequence (GCCACC)-effector protein-3' UTR (synthetic sequence) from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the nucleic acid-targeting effector protein-coding sequence and/or the guide RNA can be modified to include one or more modified nucleoside e.g., using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or particles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

CRISPR enzyme mRNA and guide RNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1× PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (such as a Group 29 or Group 30 effector protein) mRNA and guide RNA may be delivered simultaneously using particles or lipid envelopes.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr 1) describes biodegradable core-shell structured particles with a poly(O-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I.F. Expert Opin Drug Deliv, 2006. 3(5):629-40; Qu, X., et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, particles that can deliver RNA to a cancer cell to stop tumor growth developed by Dan Anderson's lab at MIT may be used and/or adapted to the nucleic acid-targeting system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the nucleic acid-targeting system of the present invention. In one aspect, the aminoalcohol lipidoid compounds are combined with an agent to be delivered to a cell or a subject to form microparticles, particles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the nucleic acid-targeting system of the present invention.

In another embodiment, lipid particles (LNPs) are contemplated. An antitransthyretin small interfering RNA has been encapsulated in lipid particles and delivered to humans (see, e.g., Coelho et al., N Engl J Med 2013; 369:819-29), and such a system may be adapted and applied to the nucleic acid-targeting system of the present invention. Doses of about 0.01 to about 1 mg per kg of body weight administered intravenously are contemplated. Medications to reduce the risk of infusion-related reactions are contemplated, such as dexamethasone, acetaminophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding nucleic acid-targeting effector protein to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, Dec. 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, Dec. 2011). A dosage of 1 µg/ml of LNP or CRISPR-Cas RNA in or associated with the LNP may be contemplated, especially for a formulation containing DLinKC2-DMA.

Preparation of LNPs and CRISPR-Cas encapsulation may be used and/or adapted from Rosin et al, Molecular Therapy, vol. 19, no. 12, pages 1286-2200, Dec. 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific nucleic acid-targeting complex (CRISPR-Cas) RNA may be encapsulated in LNPs containing DLinDAP, DLinDMA, DLinK-DMA, and DLinKC2-DMA (cationic lipid:DSPC:CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC: cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Particle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a nucleic acid-targeting system or components thereof.

Preparation of large LNPs may be used and/or adapted from Rosin et al, Molecular Therapy, vol. 19, no. 12, pages 1286-2200, Dec. 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/1, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at a RNA to total lipid ratio of approximately 1:10 (wt:wt), followed by incubation for 30 minutes at 37° C. to form loaded LNPs. The mixture may be subsequently dialyzed overnight in PBS and filtered with a 0.45-µm syringe filter.

Spherical Nucleic Acid (SNA™) constructs and other particles (particularly gold particles) are also contemplated as a means to delivery nucleic acid-targeting system to intended targets. Significant data show that AuraSense Therapeutics' Spherical Nucleic Acid (SNA™) constructs, based upon nucleic acid-functionalized gold particles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of nucleic acid-targeting complex RNA is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHS-ester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts a RNA clinical trial that uses a targeted particle-delivery system (clinical trial registration number NCT00689065). Patients with solid cancers refractory to standard-of-care therapies are administered doses of targeted particles on days 1, 3, 8 and 10 of a 21-day cycle by a 30-min intravenous infusion. The particles comprise, consist essentially of, or consist of a synthetic delivery system containing: (1) a linear, cyclodextrin-based polymer (CDP), (2) a human transferrin protein (TF) targeting ligand displayed on the exterior of the particle to engage TF receptors (TFR) on the surface of the cancer cells, (3) a hydrophilic polymer (polyethylene glycol (PEG) used to promote particle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m$^2$ siRNA, respectively. Similar doses may also be contemplated for the nucleic acid-targeting system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

In terms of this invention, it is preferred to have one or more components of nucleic acid-targeting complex, e.g., nucleic acid-targeting effector protein or mRNA, or guide RNA delivered using particles or lipid envelopes. Other delivery systems or vectors are may be used in conjunction with the particle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, particles of the invention have a greatest dimension of 100 nm or less. In other preferred embodiments, nanoparticles of the invention have a greatest dimension ranging between 35 nm and 60 nm.

Particles encompassed in the present invention may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured, and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid.

U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material.

U.S. Pat. No. 5,855,913, incorporated herein by reference, provides a particulate composition having aerodynamically light particles having a tap density of less than 0.4 g/cm3 with a mean diameter of between 5 µm and 30 µm, incorporating a surfactant on the surface thereof for drug delivery to the pulmonary system.

U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system.

U.S. Pat. No. 5,543,158, incorporated herein by reference, provides biodegradable injectable particles having a biodegradable solid core containing a biologically active material and poly(alkylene glycol) moieties on the surface.

WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such methods and materials of herein-cited documents, e.g., conjugated lipomers can be used in the context of the nucleic acid-targeting system to achieve in vitro, ex vivo and in vivo genomic perturbations to modify gene expression, including modulation of protein expression.

In one embodiment, the particle may be epoxide-modified lipid-polymer, advantageously 7C1 (see, e.g., James E. Dahlman and Carmen Barnes et al. Nature Nanotechnology (2014) published online 11 May 2014, doi:10.1038/nnano.2014.84). C71 was synthesized by reacting C15 epoxide-terminated lipids with PEI600 at a 14:1 molar ratio, and was formulated with C14PEG2000 to produce particles (diameter between 35 and 60 nm) that were stable in PBS solution for at least 40 days.

An epoxide-modified lipid-polymer may be utilized to deliver the nucleic acid-targeting system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 µg of exosomes (measured based on protein concentration) per $10^6$ cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 µF resulted in the greatest retention of RNA and was used for all subsequent experiments.

Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNA-RVG exosome-treated mice was observed, resulting from a significant decrease in BACE1 mRNA levels (66% [+ or −] 15%, P<0.001 and 61% [+ or −] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the 0-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the nucleic acid-targeting system of the present invention to therapeutic targets, especially neurodegenerative diseases. A dosage of about 100 to 1000 mg of nucleic acid-targeting system encapsulated in about 100 to 1000 mg of RVG exosomes may be contemplated for the present invention.

El-Andaloussi et al. (Nature Protocols 7,2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Qiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of nucleic acid-targeting system into exosomes may be conducted similarly to siRNA. The exosomes may be co-cultured with monocytes and lymphocytes isolated from the peripheral blood of healthy donors. Therefore, it may be contemplated that exosomes containing nucleic acid-targeting system may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at csprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the nucleic acid-targeting system or conmponents thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific nucleic acid-targeting system targeted in a SNALP are contemplated. The daily treatment may be over about three days and then weekly for about five weeks. In another embodiment, a specific nucleic acid-targeting system encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(methoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol) 2000)carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total nucleic acid-targeting systemper dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardio-myopathy (FAC) both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-Ira were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Biotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM $Na_2HPO_4$, 1 mM $KH_2PO_4$, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 m filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the nucleic acid-targeting system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate nucleic acid-targeting system or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11±0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the nucleic acid-targeting system of the present invention or component(s) thereof or nucleic acid molecule(s) coding therefor to form lipid particles (LNPs). Lipids include, but are not limited to, DLin-KC2-DMA4, C12-200 and colipids disteroylphosphatidyl choline, cholesterol, and PEG-DMG may be formulated with RNA-targeting system instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid particles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The nucleic acid-targeting system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P($O_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of nucleic acid-targeting system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of nucleic acid-targeting systems(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA should be performed to optimize the procedure for specific cell lines.

(1) One day before treatment, plate $1 \times 10^5$ cells per well in a 48-well plate.
(2) On the day of treatment, dilute purified +36 GFP protein in serumfree media to a final concentration 200 nM. Add RNA to a final concentration of 50 nM. Vortex to mix and incubate at room temperature for 10 min.
(3) During incubation, aspirate media from cells and wash once with PBS.
(4) Following incubation of +36 GFP and RNA, add the protein-RNA complexes to cells.
(5) Incubate cells with complexes at 37° C. for 4 h.
(6) Following incubation, aspirate the media and wash three times with 20 U/mL heparin PBS. Incubate cells with serum-containing media for a further 48 h or longer depending upon the assay for activity.
(7) Analyze cells by immunoblot, qPCR, phenotypic assay, or other appropriate method.

David Liu's lab has further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications.

(1) One day before treatment, plate $1 \times 10^5$ per well in a 48-well plate.
(2) On the day of treatment, dilute purified +36 GFP protein in serumfree media to a final concentration 2 mM. Add 1 mg of plasmid DNA. Vortex to mix and incubate at room temperature for 10 min.
(3) During incubation, aspirate media from cells and wash once with PBS.
(4) Following incubation of +36 GFP and plasmid DNA, gently add the protein-DNA complexes to cells.
(5) Incubate cells with complexes at 37° C. for 4 h.
(6) Following incubation, aspirate the media and wash with PBS. Incubate cells in serum-containing media and incubate for a further 24-48 h.
(7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the nucleic acid-targeting system of the present invention. These systems of Dr. Lui and documents herein in conjunction with herein teachings can be employed in the delivery of nucleic acid-targeting system(s) or component(s) thereof or nucleic acid molecule(s) coding therefor.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles including particles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intraarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Implantable Devices

In another embodiment, implantable devices are also contemplated for delivery of the nucleic acid-targeting system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used and/or adapted to the nucleic acid-targeting system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure.

US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 m$^3$ to 1000 mm$^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example the composition (optionally with the device) is optionally implanted within or in the proximity to pancreas, prostate, breast, liver, via the nipple, within the vascular system and so forth.

The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear-auditory system, labyrinth of the inner ear, vestibular system; 11. Intra tracheal; 12. Intracardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to other embodiments of US Patent Publication 20110195123, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the nucleic acid-targeting system of the present invention.

As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the nucleic acid-targeting system of the present invention.

As yet another example of a specific application, psychiatric and cognitive disorders are treated with gene modifiers. Gene knockdown is a treatment option. Loders locally delivering agents to central nervous system sites are therapeutic options for psychiatric and cognitive disorders including but not limited to psychosis, bi-polar diseases, neurotic disorders and behavioral maladies. The Loders could also deliver locally drugs including small drugs and macromolecules upon implantation at specific brain sites. All of this may be used and/or adapted to the nucleic acid-targeting system of the present invention.

As another example of a specific application, silencing of innate and/or adaptive immune mediators at local sites enables the prevention of organ transplant rejection. Local delivery of RNAs and immunomodulating reagents with the Loder implanted into the transplanted organ and/or the implanted site renders local immune suppression by repelling immune cells such as CD8 activated against the transplanted organ. All of this may be used and/or adapted to the nucleic acid-targeting system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules and small drugs stimulating angiogenesis with the Loder is therapeutic for peripheral, systemic and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

Implantable device technology herein discussed can be employed with herein teachings and hence by this disclosure and the knowledge in the art, CRISPR-Cas system or components thereof or nucleic acid molecules thereof or encoding or providing components may be delivered via an implantable device.

Patient-Specific Screening Methods

A nucleic acid-targeting system that targets RNA, e.g., trinucleotide repeats can be used to screen patients or patent samples for the presence of such repeats. The repeats can be the target of the RNA of the nucleic acid-targeting system, and if there is binding thereto by the nucleic acid-targeting system, that binding can be detected, to thereby indicate that such a repeat is present. Thus, a nucleic acid-targeting system can be used to screen patients or patient samples for the presence of the repeat. The patient can then be administered suitable compound(s) to address the condition; or, can be administered a nucleic acid-targeting system to bind to and cause insertion, deletion or mutation and alleviate the condition.

The invention uses nucleic acids to bind target RNA sequences.

CRISPR Effector Protein mRNA and Guide RNA

CRISPR effector protein mRNA and guide RNA might also be delivered separately. CRISPR effector protein mRNA can be delivered prior to the guide RNA to give time for CRISPR effector protein to be expressed. CRISPR effector protein mRNA might be administered 1-12 hours (preferably around 2-6 hours) prior to the administration of guide RNA.

Alternatively, CRISPR effector protein mRNA and guide RNA can be administered together. Advantageously, a second booster dose of guide RNA can be administered 1-12 hours (preferably around 2-6 hours) after the initial administration of CRISPR effector protein mRNA+guide RNA.

The CRISPR effector protein of the present invention, i.e. a Group 29 or Group 30 effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA or RNA binding, but not necessarily cutting or nicking, activity, including a dead-Cas effector protein function.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin—HBB (for treating Sickle Cell Anemia, including by stimulating gene-conversion (using closely related HBD gene as an endogenous template)); CD3 (T-Cells); and CEP920-retina (eye).

In some embodiments disease targets also include: cancer; Sickle Cell Anemia (based on a point mutation); HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (RiboNucleoProtein) and electroporation of plasmid DNA.

For minimization of toxicity and off-target effect, it will be important to control the concentration of CRISPR effector protein mRNA and guide RNA delivered. Optimal concentrations of CRISPR effector protein mRNA and guide RNA can be determined by testing different concentrations in a cellular or animal model and using deep sequencing the analyze the extent of modification at potential off-target genomic loci. For example, for the guide sequence targeting the sequence 5'-GAGTCCGAGCAGAAGAAGAA-3' (SEQ ID NO: 18) (artificial) in the EMX1 gene of the human genome, deep sequencing can be used to assess the level of modification at the following two off-target loci, 1: 5'-GAGTCCTAGCAGGAGAAGAA-3' (SEQ ID NO: 19) and 2: 5'-GAGTCTAAGCAGAAGAAGAA-3' (SEQ ID NO: 20) (both artificial sequences). The concentration that gives the highest level of on-target modification while minimizing the level of off-target modification should be chosen for in vivo delivery.

Inducible Systems

In some embodiments, a CRISPR effector protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283,and WO 2014018423 A2 which is hereby incorporated by reference in its entirety.

Self-Inactivating Systems

Once all copies of a gene in the genome of a cell have been edited, continued CRISPR/a Group 29 or Group 30 effector protein expression in that cell is no longer necessary. Indeed, sustained expression would be undesirable in case of off-target effects at unintended genomic sites, etc. Thus time-limited expression would be useful. Inducible expression offers one approach, but in addition Applicants have engineered a Self-Inactivating CRISPR system that relies on the use of a non-coding guide target sequence within the CRISPR vector itself. Thus, after expression begins, the CRISPR system will lead to its own destruction, but before destruction is complete it will have time to edit the genomic copies of the target gene (which, with a normal point mutation in a diploid cell, requires at most two edits). Simply, the self inactivating CRISPR-Cas system includes additional RNA (i.e., guide RNA) that targets the coding sequence for the CRISPR effector protein itself or that targets one or more non-coding guide target sequences complementary to unique sequences present in one or more of the following:

(a) within the promoter driving expression of the non-coding RNA elements,
  (b) within the promoter driving expression of the effector protein gene,
  (c) within 100 bp of the ATG translational start codon in the effector protein coding sequence, (d) within the inverted terminal repeat (iTR) of a viral delivery vector, e.g., in the AAV genome.

Furthermore, that RNA can be delivered via a vector, e.g., a separate vector or the same vector that is encoding the CRISPR complex. When provided by a separate vector, the CRISPR RNA that targets Cas expression can be administered sequentially or simultaneously. When administered sequentially, the CRISPR RNA that targets Cas expression is to be delivered after the CRISPR RNA that is intended for e.g. gene editing or gene engineering. This period may be a period of minutes (e.g. 5 minutes, 10 minutes, 20 minutes, 30 minutes, 45 minutes, 60 minutes). This period may be a period of hours (e.g. 2 hours, 4 hours, 6 hours, 8 hours, 12 hours, 24 hours). This period may be a period of days (e.g. 2 days, 3 days, 4 days, 7 days). This period may be a period of weeks (e.g. 2 weeks, 3 weeks, 4 weeks). This period may be a period of months (e.g. 2 months, 4 months, 8 months, 12 months). This period may be a period of years (2 years, 3 years, 4 years). Where the guide RNA targets the sequences encoding expression of the Cas protein, the effector protein becomes impeded and the system becomes self inactivating. In the same manner, CRISPR RNA that targets Cas expression applied via, for example liposome, lipofection, particles, microvesicles as explained herein, may be administered sequentially or simultaneously. Similarly, self-inactivation may be used for inactivation of one or more guide RNA used to target one or more targets.

In some aspects, a single gRNA is provided that is capable of hybridization to a sequence downstream of a CRISPR effector protein start codon, whereby after a period of time there is a loss of the CRISPR effector protein expression. In some aspects, one or more gRNA(s) are provided that are capable of hybridization to one or more coding or non-coding regions of the polynucleotide encoding the CRISPR-Cas system, whereby after a period of time there is a inactivation of one or more, or in some cases all, of the CRISPR-Cas system. In some aspects of the system, and not to be limited by theory, the cell may comprise a plurality of CRISPR-Cas complexes, wherein a first subset of CRISPR complexes comprise a first guide RNA capable of targeting a genomic locus or loci to be edited, and a second subset of CRISPR complexes comprise at least one second guide RNA capable of targeting the polynucleotide encoding the CRISPR-Cas system, wherein the first subset of CRISPR-Cas complexes mediate editing of the targeted genomic locus or loci and the second subset of CRISPR complexes eventually inactivate the CRISPR-Cas system, thereby inactivating further CRISPR-Cas expression in the cell.

Thus the invention provides a CRISPR-Cas system comprising one or more vectors for delivery to a eukaryotic cell, wherein the vector(s) encode(s): (i) a CRISPR effector protein; (ii) a first guide RNA capable of hybridizing to a target sequence in the cell; (iii) a second guide RNA capable of hybridizing to one or more target sequence(s) in the vector which encodes the CRISPR effector protein;, thus differing only by the guide sequence, wherein, when expressed within the cell: the first guide RNA directs sequence-specific binding of a first CRISPR complex to the target sequence in the cell; the second guide RNA directs sequence-specific binding of a second CRISPR complex to the target sequence in the vector which encodes the CRISPR effector protein; the CRISPR complexes comprise a CRISPR effector protein bound to a guide RNA, such that a guide RNA can hybridize to its target sequence; and the second CRISPR complex inactivates the CRISPR-Cas system to prevent continued expression of the CRISPR effector protein by the cell.

The various coding sequences (CRISPR effector protein and guide RNAs) can be included on a single vector or on multiple vectors. For instance, it is possible to encode the effector protein on one vector and the various RNA sequences on another vector, or to encode the effector protein and one guide RNA on one vector, and the remaining guide RNA on another vector, or any other permutation. In general, a system using a total of one or two different vectors is preferred.

Where multiple vectors are used, it is possible to deliver them in unequal numbers, and ideally with an excess of a vector which encodes the first guide RNA relative to the second guide RNA, thereby assisting in delaying final inactivation of the CRISPR system until genome editing has had a chance to occur.

The first guide RNA can target any target sequence of interest within a genome, as described elsewhere herein. The second guide RNA targets a sequence within the vector which encodes the CRISPR Group 29 or Group 30 effector protein, and thereby inactivates the effector protein's expression from that vector. Thus the target sequence in the vector must be capable of inactivating expression. Suitable target sequences can be, for instance, near to or within the translational start codon for the Group 29 or Group 30 effector protein coding sequence, in a non-coding sequence in the promoter driving expression of the non-coding RNA elements, within the promoter driving expression of the Group 29 or Group 30 effector protein gene, within 100 bp of the ATG translational start codon in the Cas coding sequence, and/or within the inverted terminal repeat (iTR) of a viral delivery vector, e.g., in the AAV genome. A double stranded break near this region can induce a frame shift in the Cas coding sequence, causing a loss of protein expression. An alternative target sequence for the "self-inactivating" guide RNA would aim to edit/inactivate regulatory regions/sequences needed for the expression of the CRISPR-system or for the stability of the vector. For instance, if the promoter for the Cas coding sequence is disrupted then transcription can be inhibited or prevented. Similarly, if a vector includes sequences for replication, maintenance or stability then it is possible to target these. For instance, in a AAV vector a useful target sequence is within the iTR. Other useful sequences to target can be promoter sequences, polyadenlyation sites, etc.

Furthermore, if the guide RNAs are expressed in array format, the "self-inactivating" guide RNAs that target both promoters simultaneously will result in the excision of the intervening nucleotides from within the CRISPR-Cas expression construct, effectively leading to its complete inactivation. Similarly, excision of the intervening nucleotides will result where the guide RNAs target both ITRs, or targets two or more other CRISPR-Cas components simultaneously. Self-inactivation as explained herein is applicable, in general, with CRISPR-Cas systems in order to provide regulation of the CRISPR-Cas. For example, self-inactivation as explained herein may be applied to the CRISPR repair of mutations, for example expansion disorders, as explained herein. As a result of this self-inactivation, CRISPR repair is only transiently active.

Addition of non-targeting nucleotides to the 5' end (e.g. 1-10 nucleotides, preferably 1-5 nucleotides) of the "self-inactivating" guide RNA can be used to delay its processing and/or modify its efficiency as a means of ensuring editing at the targeted genomic locus prior to CRISPR-Cas shut-down.

In one aspect of the self-inactivating AAV-CRISPR-Cas system, plasmids that co-express one or more guide RNA targeting genomic sequences of interest (e.g. 1-2, 1-5, 1-10, 1-15, 1-20, 1-30) may be established with "self-inactivating" guide RNAs that target an SpCas9 sequence at or near the engineered ATG start site (e.g. within 5 nucleotides, within 15 nucleotides, within 30 nucleotides, within 50 nucleotides, within 100 nucleotides). A regulatory sequence in the U6 promoter region can also be targeted with an guide RNA. The U6-driven guide RNAs may be designed in an array format such that multiple guide RNA sequences can be simultaneously released. When first delivered into target tissue/cells (left cell) guide RNAs begin to accumulate while Cas levels rise in the nucleus. Cas complexes with all of the guide RNAs to mediate genome editing and self-inactivation of the CRISPR-Cas plasmids.

One aspect of a self-inactivating CRISPR-Cas system is expression of singly or in tandem array format from 1 up to 4 or more different guide sequences; e.g. up to about 20 or about 30 guides sequences. Each individual self inactivating guide sequence may target a different target. Such may be processed from, e.g. one chimeric pol3 transcript. Pol3 promoters such as U6 or H1 promoters may be used. Pol2 promoters such as those mentioned throughout herein. Inverted terminal repeat (iTR) sequences may flank the Pol3 promoter—guide RNA(s)-Pol2 promoter-Cas.

One aspect of a tandem array transcript is that one or more guide(s) edit the one or more target(s) while one or more self inactivating guides inactivate the CRISPR-Cas system. Thus, for example, the described CRISPR-Cas system for repairing expansion disorders may be directly combined with the self-inactivating CRISPR-Cas system described herein. Such a system may, for example, have two guides directed to the target region for repair as well as at least a third guide directed to self-inactivation of the CRISPR-Cas. Reference is made to Application Ser. No. PCT/US2014/069897, entitled "Compositions And Methods Of Use Of Crispr-Cas Systems In Nucleotide Repeat Disorders," published Dec. 12, 2014 as WO/2015/089351.

Kits

In one aspect, the invention provides kits containing any one or more of the elements disclosed in the above methods and compositions. In some embodiments, the kit comprises a vector system as taught herein or one or more of the components of the CRISPR/Cas system as taught herein, such as gRNAs and/or effector protein or effector protein encoding mRNA, and instructions for using the kit. Elements may be provide individually or in combinations, and may be provided in any suitable container, such as a vial, a bottle, or a tube. In some embodiments, the kit includes instructions in one or more languages, for example in more than one language. The instructions may be specific to the applications and methods described herein.

In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g., in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide sequence and a regulatory element. In some embodiments, the kit comprises one or more of the vectors and/or one or more of the polynucleotides described herein. The kit may advantageously allows to provide all elements of the systems of the invention.

In one aspect, the invention provides methods for using one or more elements of a CRISPR system. The CRISPR complex of the invention provides an effective means for modifying a target polynucleotide. The CRISPR complex of the invention has a wide variety of utility including modifying (e.g., deleting, inserting, translocating, inactivating, activating) a target polynucleotide in a multiplicity of cell types. As such the CRISPR complex of the invention has a broad spectrum of applications in, e.g., gene therapy, drug screening, disease diagnosis, and prognosis. An exemplary CRISPR complex comprises a CRISPR effector protein complexed with a guide sequence hybridized to a target sequence within the target polynucleotide. In certain embodiments, a direct repeat sequence is linked to the guide sequence.

In one embodiment, this invention provides a method of cleaving a target polynucleotide. The method comprises modifying a target polynucleotide using a CRISPR complex that binds to the target polynucleotide and effect cleavage of said target polynucleotide. Typically, the CRISPR complex of the invention, when introduced into a cell, creates a break (e.g., a single or a double strand break) in the target sequence. For example, the method can be used to cleave a disease gene or gene product in a cell.

Where desired, a donor polynucleotide can be DNA, e.g., a DNA plasmid, a bacterial artificial chromosome (BAC), a yeast artificial chromosome (YAC), a viral vector, a linear piece of DNA, a PCR fragment, a naked nucleic acid, or a nucleic acid complexed with a delivery vehicle such as a liposome or poloxamer.

In other embodiments, this invention provides a method of modifying expression of a polynucleotide in a eukaryotic cell. The method comprises increasing or decreasing expression of a target polynucleotide by using a CRISPR complex that binds to the polynucleotide.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In some methods, a control sequence can be inactivated such that it no longer functions as a control sequence. As used herein, "control sequence" refers to any nucleic acid sequence that effects the transcription, translation, or accessibility of a nucleic acid sequence. Examples of a control sequence include, a promoter, a transcription terminator, and an enhancer are control sequences. The inactivated target sequence may include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). In some methods, the inactivation of a target sequence results in "knockout" of the target sequence.

Exemplary Methods of Using of CRISPR Cas System

The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy, and/or gene knockdown.

Modifying a Target with CRISPR Cas System or Complex (e.g., Group 29 or Group 30 Effector Protein-RNA Complex)

In one aspect, the invention provides for methods of modifying a target polynucleotide in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

In some embodiments, the method comprises allowing a CRISPR complex to bind to the target polynucleotide to effect cleavage of said target polynucleotide thereby modifying the target polynucleotide, wherein the CRISPR complex comprises a CRISPR effector protein complexed with a guide sequence hybridized or hybridizable to a target sequence within said target polynucleotide.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR effector protein complexed with a guide sequence hybridized or hybridizable to a target sequence within said polynucleotide. Similar considerations and conditions apply as above for methods of modifying a target polynucleotide. In fact, these sampling, culturing and re-introduction options apply across the aspects of the present invention.

Indeed, in any aspect of the invention, the CRISPR complex may comprise a CRISPR effector protein complexed with a guide sequence hybridized or hybridizable to a target sequence. Similar considerations and conditions apply as above for methods of modifying a target polynucleotide.

Thus in any of the non-naturally-occurring CRISPR effector proteins described herein comprise at least one modification and whereby the effector protein has certain improved capabilities. In particular, any of the effector proteins are capable of forming a CRISPR complex with a guide RNA. When such a complex forms, the guide RNA is capable of binding to a target polynucleotide sequence and the effector protein is capable of modifying a target locus. In addition, the effector protein in the CRISPR complex has reduced capability of modifying one or more off-target loci as compared to an unmodified enzyme/effector protein.

In addition, the modified CRISPR enzymes described herein encompass enzymes whereby in the CRISPR complex the effector protein has increased capability of modifying the one or more target loci as compared to an unmodified enzyme/effector protein. Such function may be provided separate to or provided in combination with the above-described function of reduced capability of modifying one or more off-target loci. Any such effector proteins may be provided with any of the further modifications to the CRISPR effector protein as described herein, such as in combination with any activity provided by one or more associated heterologous functional domains, any further mutations to reduce nuclease activity and the like.

In advantageous embodiments of the invention, the modified CRISPR effector protein is provided with reduced capability of modifying one or more off-target loci as compared to an unmodified enzyme/effector protein and increased capability of modifying the one or more target loci as compared to an unmodified enzyme/effector protein. In combination with further modifications to the effector protein, significantly enhanced specificity may be achieved. For example, combination of such advantageous embodiments with one or more additional mutations is provided wherein the one or more additional mutations are in one or more catalytically active domains. Such further catalytic mutations may confer nickase functionality as described in detail elsewhere herein. In such effector proteins, enhanced specificity may be achieved due to an improved specificity in terms of effector protein activity.

Modifications to reduce off-target effects and/or enhance on-target effects as described above may be made to amino acid residues located in a positively-charged region/groove situated between the RuvC-III and HNH domains. It will be appreciated that any of the functional effects described above may be achieved by modification of amino acids within the aforementioned groove but also by modification of amino acids adjacent to or outside of that groove.

Additional functionalities which may be engineered into modified CRISPR effector proteins as described herein include the following. 1. Modified CRISPR effector proteins that disrupt DNA: or RNA:protein interactions without affecting protein tertiary or secondary structure. This includes residues that contact any part of the RNA:DNA or RNA:RNA duplex. 2. modified CRISPR effector proteins that weaken intra-protein interactions holding the effector protein in conformation essential for nuclease cutting in response to DNA/RNA binding (on or off target). For example: a modification that mildly inhibits, but still allows, the nuclease conformation of the HNH domain (positioned at the scissile phosphate). 3. Modified CRISPR effector proteins that strengthen intra-protein interactions holding the effector protein in a conformation inhibiting nuclease activity in response to DNA/RNA binding (on or off targets). For example: a modification that stabilizes the HNH domain in a conformation away from the scissile phosphate. Any such additional functional enhancement may be provided in combination with any other modification to the CRISPR effector protein as described in detail elsewhere herein.

Any of the herein described improved functionalities may be made to any CRISPR effector proteinGroup 29 or Group 30 effector protein. However, it will be appreciated that any of the functionalities described herein may be engineered into Group 29 or Group 30 Group 29 or Group 30 effector proteins from other orthologs, including chimeric effector proteins comprising fragments from multiple orthologs.

The invention uses nucleic acids to bind target DNA or RNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

In aspects of the invention the term "guide RNA", refers to the polynucleotide sequence comprising one or more of a putative or identified tracr sequence and a putative or identified crRNA sequence or guide sequence. In particular embodiments, the "guide RNA" comprises a putative or identified crRNA sequence or guide sequence. In further embodiments, the guide RNA does not comprise a putative or identified tracr sequence.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 *Nuc. Acids Research* 12 p387). Examples of other software than may perform sequence comparisons include, but are not limited to, the BLAST package (see Ausubel et al., 1999 *Short Protocols in Molecular Biology*, 4$^{th}$ Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, *Short Protocols in Molecular Biology*, pages 7-58 to 7-60). However, for some applications, it is preferred to use the GCG Bestfit program. A new tool, called BLAST 2 Sequences is also available for comparing protein and nucleotide sequences (see *FEMS Microbiol Lett.* 1999 174 (2): 247-50; *FEMS Microbiol Lett.* 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C.D. and Barton G.J. (1993) "Protein sequence alignments: a strategy for the hierarchical analysis of residue conservation" *Comput. Appl. Biosci.* 9: 745-756) (Taylor W.R. (1986) "The classification of amino acid conservation" *J. Theor. Biol.* 119; 205-218). Conservative substitutions may be made, for example according to the table below which describes a generally accepted Venn diagram grouping of amino acids.

| Set | | Sub-set | |
|---|---|---|---|
| Hydrophobic | FWYHKMILVAGC (SEQ ID NO: 21) | Aromatic | F W Y H (SEQ ID NO: 22) |
| | | Aliphatic | I L V (SEQ ID NO: 23) |
| Polar | WYHKREDCSTNQ (SEQ ID NO: 24) | Charged | H K R E D (SEQ ID NO: 25) |
| | | Positively charged | H K R (SEQ ID NO: 26) |
| | | Negatively charged | E D (SEQ ID NO: 27) |
| Small | VCAGSPTND (SEQ ID NO: 28) | Tiny | A G S (SEQ ID NO: 29) |

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M.J. MacPherson, B.D. Hames and G.R. Taylor eds. (1995)), Harlow and Lane, eds. (1988) ANTIBODIES, A LABORATORY MANUAL, and ANIMAL CELL CULTURE (R.I. Freshney, ed. (1987)).

Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyridyl-alanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or P-alanine residues. A further form of variation, which involves the presence of one or more amino acid residues in peptoid form, may be well understood by those skilled in the art. For the avoidance of doubt, "the peptoid form" is used to refer to variant amino acid residues wherein the a-carbon substituent group is on the residue's nitrogen atom rather than the a-carbon. Processes for preparing peptides in the peptoid form are known in the art, for example Simon R J et al., PNAS (1992) 89(20), 9367-9371 and Horwell D C, *Trends Biotechnol.* (1995) 13(4), 132-134.

Homology modelling: Corresponding residues in other Group 29 or Group 30 orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR.

In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

Aspects of the invention relate to bicistronic vectors for guide RNA and wild type, modified or mutated CRISPR effector proteins/enzymes (e.g. Group 29 or Group 30 effector proteins). Bicistronic expression vectors guide RNA and wild type, modified or mutated CRISPR effector proteins/enzymes (e.g. Group 29 or Group 30 effector proteins) are preferred. In general and particularly in this embodiment and wild type, modified or mutated CRISPR effector proteins/enzymes (e.g. Group 29 or Group 30 effector proteins) is preferably driven by the CBh promoter. The RNA may preferably be driven by a Pol III promoter, such as a U6 promoter. Ideally the two are combined.

In some embodiments, a loop in the guide RNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces cerevisiae* include pYepSec1 (Baldari, et al., 1987. EMBO J. 6: 229-234), pMFa (Kuijan and Herskowitz, 1982. Cell 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Luckow and Summers, 1989. *Virology* 170: 31-39).

In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the a-fetoprotein promoter (Campes and Tilghman, 1989. *Genes Dev.* 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, *Pyrobaculum, Sulfolobus, Archaeoglobus, Haloarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium*, Azoarcus, Chromobacterium, *Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema,* and *Thermotoga*.

In general, "nucleic acid-targeting system" as used in the present application refers collectively to transcripts and other elements involved in the expression of or directing the activity of nucleic acid-targeting CRISPR-associated ("Cas") genes (also referred to herein as an effector protein), including sequences encoding a nucleic acid-targeting Cas (effector) protein and a guide RNA (comprising crRNA sequence and a trans-activating CRISPR/Cas system RNA (tracrRNA) sequence), or other sequences and transcripts from a nucleic acid-targeting CRISPR locus. In some embodiments, one or more elements of a nucleic acid-targeting system are derived from a Type V/Type VI nucleic acid-targeting CRISPR system. In some embodiments, one or more elements of a nucleic acid-targeting system is derived from a particular organism comprising an endogenous nucleic acid-targeting CRISPR system. In general, a nucleic acid-targeting system is characterized by elements that promote the formation of a nucleic acid-targeting complex at the site of a target sequence. In the context of formation of a nucleic acid-targeting complex, "target sequence" refers to a sequence to which a guide sequence is designed to have complementarity, where hybridization between a target sequence and a guide RNA promotes the formation of a DNA or RNA-targeting complex. Full complementarity is not necessarily required, provided there is sufficient complementarity to cause hybridization and promote formation of a nucleic acid-targeting complex. A target sequence may comprise RNA polynucleotides. In some embodiments, a target sequence is located in the nucleus or cytoplasm of a cell. In some embodiments, the target sequence may be within an organelle of a eukaryotic cell, for example, mitochondrion or chloroplast.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both RNA strands in or near (e.g. within 1, 2, 3, 4, 5, 6, 7, 8, 9, 10, 20, 50, or more base pairs from) the target sequence. In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector protein and a guide RNA could each be operably linked to separate regulatory elements on separate vectors. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and a guide RNA embedded within one or more intron sequences (e.g. each in a different intron, two or more in at least one intron, or all in a single intron). In some embodiments, the nucleic acid-targeting effector protein and guide RNA are operably linked to and expressed from the same promoter.

In general, a guide sequence is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), Clustal W, Clustal X, BLAT, Novoalign (Novocraft Technologies, ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a nucleic acid-targeting complex to a target sequence may be assessed by any suitable assay. For example, the components of a nucleic acid-targeting system sufficient to form a nucleic acid-targeting complex, including the guide sequence to be tested, may be provided to a host cell having the corresponding target sequence, such as by transfection with vectors encoding the components of the nucleic acid-targeting CRISPR sequence, followed by an assessment of preferential cleavage within or in the vicinity of the target sequence, such as by Surveyor assay as described herein. Similarly, cleavage of a target polynucleotide sequence (or a sequence in the vicinity thereof) may be evaluated in a test tube by providing the target sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art.

A guide sequence may be selected to target any target sequence. In some embodiments, the target sequence is a sequence within a gene transcript or mRNA.

In some embodiments, the target sequence is a sequence within a genome of a cell.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A.R. Gruber et al., 2008, Cell 106(1): 23-24; and PA Carr and GM Church, 2009, Nature Biotechnology 27(12): 1151-62). Further algorithms may be found in U.S. application Serial No. TBA; incorporated herein by reference.

In some embodiments, the nucleic acid-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR effector protein/enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR effector protein/enzyme fusion protein may comprise any additional protein sequence, and optionally a linker sequence between any two domains. Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A nucleic acid-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a nucleic acid-targeting effector protein are described in US20110059502, incorporated herein by reference. In some embodiments, a tagged nucleic acid-targeting effector protein is used to identify the location of a target sequence.

In some embodiments, a CRISPR enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome).In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety.

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a nucleic acid-targeting effector protein in combination with (and optionally complexed with) a guide RNA is delivered to a cell. Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., *J. Virol.* 63:03822-3828 (1989).

Models of Genetic and Epigenetic Conditions

A method of the invention may be used to create a plant, an animal or cell that may be used to model and/or study genetic or epigenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal or cell in which the expression of one or more nucleic acid sequences associated with a disease are altered. Such a nucleic acid sequence may encode a disease associated protein sequence or may be a disease associated control sequence. Accordingly, it is understood that in embodiments of the invention, a plant, subject, patient, organism or cell can be a non-human subject, patient, organism or cell. Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged.

In some methods, the disease model can be used to study the effects of mutations, or more general altered, such as reduced, expression of genes or gene products on the animal or cell and development and/or progression of the disease using measures commonly used in the study of the disease. Alternatively, such a disease model is useful for studying the effect of a pharmaceutically active compound on the disease.

In some methods, the disease model can be used to assess the efficacy of a potential gene therapy strategy. That is, a disease-associated gene or polynucleotide can be modified such that the disease development and/or progression is inhibited or reduced. In particular, the method comprises modifying a disease-associated gene or polynucleotide such that an altered protein is produced and, as a result, the animal or cell has an altered response. Accordingly, in some methods, a genetically modified animal may be compared with an animal predisposed to development of the disease such that the effect of the gene therapy event may be assessed.

In another embodiment, this invention provides a method of developing a biologically active agent that modulates a cell signaling event associated with a disease gene. The method comprises contacting a test compound with a cell comprising one or more vectors that drive expression of one or more of a CRISPR enzyme, and a direct repeat sequence linked to a guide sequence; and detecting a change in a readout that is indicative of a reduction or an augmentation of a cell signaling event associated with, e.g., a mutation in a disease gene contained in the cell.

A cell model or animal model can be constructed in combination with the method of the invention for screening a cellular function change. Such a model may be used to study the effects of a genome sequence modified by the CRISPR complex of the invention on a cellular function of interest. For example, a cellular function model may be used to study the effect of a modified genome sequence on intracellular signaling or extracellular signaling. Alternatively, a cellular function model may be used to study the effects of a modified genome sequence on sensory perception. In some such models, one or more genome sequences associated with a signaling biochemical pathway in the model are modified.

Several disease models have been specifically investigated. These include de novo autism risk genes CHD8, KATNAL2, and SCN2A; and the syndromic autism (Angelman Syndrome) gene UBE3A. These genes and resulting autism models are of course preferred, but serve to show the broad applicability of the invention across genes and corresponding models.

An altered expression of one or more genome sequences associated with a signalling biochemical pathway can be determined by assaying for a difference in the mRNA levels of the corresponding genes between the test model cell and a control cell, when they are contacted with a candidate agent. Alternatively, the differential expression of the sequences associated with a signaling biochemical pathway is determined by detecting a difference in the level of the encoded polypeptide or gene product.

To assay for an agent-induced alteration in the level of mRNA transcripts or corresponding polynucleotides, nucleic acid contained in a sample is first extracted according to standard methods in the art. For instance, mRNA can be isolated using various lytic enzymes or chemical solutions according to the procedures set forth in Sambrook et al. (1989), or extracted by nucleic-acid-binding resins following the accompanying instructions provided by the manufacturers. The mRNA contained in the extracted nucleic acid sample is then detected by amplification procedures or conventional hybridization assays (e.g. Northern blot analysis) according to methods widely known in the art or based on the methods exemplified herein.

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Hoeste, SYBR gold, ethidium bromide, acridines, proflavine, acridine orange, acriflavine, fluorcoumanin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan® probes) resulting in increased specificity and sensitivity. Methods for performing probe-based quantitative amplification are well established in the art and are taught in U.S. Pat. No. 5,210,015.

In yet another aspect, conventional hybridization assays using hybridization probes that share sequence homology with sequences associated with a signaling biochemical pathway can be performed. Typically, probes are allowed to form stable complexes with the sequences associated with a signaling biochemical pathway contained within the biological sample derived from the test subject in a hybridization reaction. It will be appreciated by one of skill in the art that where antisense is used as the probe nucleic acid, the target polynucleotides provided in the sample are chosen to be complementary to sequences of the antisense nucleic acids. Conversely, where the nucleotide probe is a sense nucleic acid, the target polynucleotide is selected to be complementary to sequences of the sense nucleic acid.

Hybridization can be performed under conditions of various stringency. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Sambrook, et al., (1989); Nonradioactive In Situ Hybridization Application Manual, Boehringer Mannheim, second edition). The hybridization assay can be formed using probes immobilized on any solid support, including but are not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, β-galactosidase, urease, alkaline phosphatase or peroxidase, avidin/biotin complex.

The detection methods used to detect or quantify the hybridization intensity will typically depend upon the label selected above. For example, radiolabels may be detected using photographic film or a phosphorimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

An agent-induced change in expression of sequences associated with a signaling biochemical pathway can also be determined by examining the corresponding gene products. Determining the protein level typically involves a) contacting the protein contained in a biological sample with an agent that specifically bind to a protein associated with a signaling biochemical pathway; and (b) identifying any agent:protein complex so formed. In one aspect of this embodiment, the agent that specifically binds a protein associated with a signaling biochemical pathway is an antibody, preferably a monoclonal antibody.

The reaction is performed by contacting the agent with a sample of the proteins associated with a signaling biochemical pathway derived from the test samples under conditions that will allow a complex to form between the agent and the proteins associated with a signaling biochemical pathway. The formation of the complex can be detected directly or indirectly according to standard procedures in the art. In the direct detection method, the agents are supplied with a detectable label and unreacted agents may be removed from the complex; the amount of remaining label thereby indicating the amount of complex formed. For such method, it is preferable to select labels that remain attached to the agents even during stringent washing conditions. It is preferable that the label does not interfere with the binding reaction. In the alternative, an indirect detection procedure may use an agent that contains a label introduced either chemically or enzymatically. A desirable label generally does not interfere with binding or the stability of the resulting agent:polypeptide complex. However, the label is typically designed to be accessible to an antibody for an effective binding and hence generating a detectable signal.

A wide variety of labels suitable for detecting protein levels are known in the art. Non-limiting examples include radioisotopes, enzymes, colloidal metals, fluorescent compounds, bioluminescent compounds, and chemiluminescent compounds.

The amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

A number of techniques for protein analysis based on the general principles outlined above are available in the art. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

Antibodies that specifically recognize or bind to proteins associated with a signaling biochemical pathway are preferable for conducting the aforementioned protein analyses. Where desired, antibodies that recognize a specific type of post-translational modifications (e.g., signaling biochemical pathway inducible modifications) can be used. Post-translational modifications include but are not limited to glycosylation, lipidation, acetylation, and phosphorylation. These antibodies may be purchased from commercial vendors. For example, anti-phosphotyrosine antibodies that specifically recognize tyrosine-phosphorylated proteins are available from a number of vendors including Invitrogen and Perkin Elmer. Antiphosphotyrosine antibodies are particularly useful in detecting proteins that are differentially phosphorylated on their tyrosine residues in response to an ER stress. Such proteins include but are not limited to eukaryotic translation initiation factor 2 alpha (eIF-2α). Alternatively, these antibodies can be generated using conventional polyclonal or monoclonal antibody technologies by immunizing a host animal or an antibody-producing cell with a target protein that exhibits the desired post-translational modification.

In practicing the subject method, it may be desirable to discern the expression pattern of an protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

An altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays such as AlphaScreen™ (available from Perkin Elmer) and eTag™ assay (Chan-Hui, et al. (2003) Clinical Immunology 111: 162-174).

Where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are particularly suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a minisecond.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding or encoded by a gene product (e.g., a protein) or a non-coding (RNA) sequence (e.g., a regulatory polynucleotide or a junk DNA).

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, it is believed that the target sequence may be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence) Examples of PAM sequences are given in the examples section below, and the skilled person will be able to identify further PAM sequences for use with a given CRISPR enzyme.

The target polynucleotide of a CRISPR complex may include a number of disease associated genes and polynucleotides as well as signaling biochemical pathway-associated genes and polynucleotides as listed in U.S. provisional patent applications 61/736,527 and 61/748,427 both entitled SYSTEMS METHODS AND COMPOSITIONS FOR SEQUENCE MANIPULATION filed on Dec. 12, 2012 and Jan. 2, 2013, respectively, and PCT Application PCT/US2013/074667, entitled DELIVERY, ENGINEERING AND OPTIMIZATION OF SYSTEMS, METHODS AND COMPOSITIONS FOR SEQUENCE MANIPULATION AND THERAPEUTIC APPLICATIONS, filed Dec. 12, 2013, the contents of all of which are herein incorporated by reference in their entirety.

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Genome/Transcriptome Wide Knock-Out or Knock-Down Screening

The CRISPR effector protein complexes described herein can be used to perform efficient and cost effective functional genomic screens. Such screens can utilize CRISPR effector protein based genome wide libraries. Such screens and libraries can provide for determining the function of genes, cellular pathways genes are involved in, and how any alteration in gene expression can result in a particular biological process. An advantage of the present invention is that the CRISPR system avoids off-target binding and its resulting side effects. This is achieved using systems arranged to have a high degree of sequence specificity for the target DNA/RNA. In preferred embodiments of the invention, the CRISPR effector protein complexes are Group 29 or Group 30 effector protein complexes.

In embodiments of the invention, a genome wide library may comprise a plurality of Group 29 or Group 30 effector protein guide RNAs, as described herein, comprising guide sequences that are capable of targeting a plurality of target sequences in a plurality of loci in a population of eukaryotic cells. The population of cells may be a population of embryonic stem (ES) cells. The target sequence in the genomic locus may be a non-coding sequence. The non-coding sequence may be an intron, regulatory sequence, splice site, 3' UTR, 5' UTR, or polyadenylation signal. Gene function of one or more gene products may be altered by said targeting. The targeting may result in a knockout of gene function. The targeting of a gene product may comprise more than one guide RNA. A gene product may be targeted by 2, 3, 4, 5, 6, 7, 8, 9, or 10 guide RNAs, for example 3 to 4 per gene. Off-target modifications may be minimized by exploiting the staggered double strand breaks generated by Group 29 or Group 30 effector protein complexes or by utilizing methods analogous to those used in CRISPR-Cas9 systems (See, e.g., DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, TJ., Marraffini, LA., Bao, G., & Zhang, F. *Nat Biotechnol* doi:10.1038/nbt.2647 (2013)), incorporated herein by reference. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the invention comprehends a genome or transcriptome wide library that may comprise a plurality of Group 29 or Group 30 guide RNAs that may comprise guide sequences that are capable of targeting a plurality of target sequences in a plurality of loci, wherein said targeting results in a knockout or knockdown of gene function. This library may potentially comprise guide RNAs that target each and every gene in the genome of an organism.

In some embodiments of the invention the organism or subject is a eukaryote (including mammal including human) or a non-human eukaryote or a non-human animal or a non-human mammal. In some embodiments, the organism or subject is a non-human animal, and may be an arthropod, for example, an insect, or may be a nematode. In some methods of the invention the organism or subject is a plant. In some methods of the invention the organism or subject is a mammal or a non-human mammal. A non-human mammal may be for example a rodent (preferably a mouse or a rat), an ungulate, or a primate. In some methods of the invention the organism or subject is algae, including microalgae, or is a fungus.

The knockout or knockdown of gene function may comprise: introducing into each cell in the population of cells a vector system of one or more vectors comprising an engineered, non-naturally occurring Group 29 or Group 30 effector protein of Group 29 or Group 30 effector protein system comprising I. a Group 29 or Group 30 effector protein, and II. one or more guide RNAs, wherein components I and II may be same or on different vectors of the system, integrating components I and II into each cell, wherein the guide sequence targets a unique gene, or transcript thereof, or other RNA sequence in each cell, wherein the Group 29 or Group 30 effector protein is operably linked to a regulatory element, wherein when transcribed, the guide RNA comprising the guide sequence directs sequence-specific binding of the Group 29 or Group 30 effector protein-Group 29 or Group 30 effector protein system to a target sequence in the loci of the unique gene (transcript) or other RNA as described herein elsewhere, inducing cleavage of the loci by the Group 29 or Group 30 effector protein, and confirming different knockout/knockdown mutations in a plurality of unique targets in each cell of the population of cells thereby generating a gene knockout/knockdown cell library. The invention comprehends that the population of cells is a population of eukaryotic cells, and in a preferred embodiment, the population of cells is a population of embryonic stem (ES) cells.

The one or more vectors may be plasmid vectors. The vector may be a single vector comprising a Group 29 or Group 30 effector protein, a sgRNA, and optionally, a selection marker into target cells. Not being bound by a theory, the ability to simultaneously deliver a Group 29 or Group 30 effector protein and sgRNA through a single vector enables application to any cell type of interest, without the need to first generate cell lines that express the Group 29 or Group 30 effector protein. The regulatory element may be an inducible promoter. The inducible promoter may be a doxycycline inducible promoter. In some methods of the invention the expression of the guide sequence is under the control of the T7 promoter and is driven by the expression of T7 polymerase. The confirming of different knockout/knockdown mutations may be by whole exome/transcriptome sequencing. The knockout/knockdown mutation may be achieved in 100 or more unique genes. The knockout/knockdown mutation may be achieved in 1000 or more unique genes. The knockout mutation may be achieved in 20,000 or more unique genes. The knockout/knockdown mutation may be achieved in the entire genome/transcriptome. The knockout/knockdown of gene function may be achieved in a plurality of unique genes which function in a particular physiological pathway or condition. The pathway or condition may be an immune pathway or condition. The pathway or condition may be a cell division pathway or condition.

The invention also provides kits that comprise the genome/transcriptome (or other RNAs, as described herein elsewhere) wide libraries mentioned herein. The kit may comprise a single container comprising vectors or plasmids comprising the library of the invention. The kit may also comprise a panel comprising a selection of unique Group 29 or Group 30 effector proteinGroup 29 or Group 30 effector protein system guide RNAs comprising guide sequences from the library of the invention, wherein the selection is indicative of a particular physiological condition. The invention comprehends that the targeting is of about 100 or more sequences, about 1000 or more sequences or about 20,000 or more sequences or the entire genome/transcriptome. Furthermore, a panel of target sequences may be focused on a relevant or desirable pathway, such as an immune pathway or cell division.

In an additional aspect of the invention, the Group 29 or Group 30 effector protein may comprise one or more mutations and may be used as a generic DNA/RNA binding protein with or without fusion to a functional domain. The mutations may be artificially introduced mutations or gain- or loss-of-function mutations. The mutations have been characterized as described herein. In one aspect of the invention, the functional domain may be a transcriptional activation domain, which may be VP64. In other aspects of the invention, the functional domain may be a transcriptional repressor domain, which may be KRAB or SID4X. Other aspects of the invention relate to the mutated Group 29 or Group 30 effector protein being fused to domains which include but are not limited to a transcriptional activator, repressor, a recombinase, a transposase, a histone remodeler, a demethylase, a DNA methyltransferase, a cryptochrome, a light inducible/controllable domain or a chemically inducible/controllable domain. Some methods of the invention can include inducing expression of targeted genes. In one embodiment, inducing expression by targeting a plurality of target sequences in a plurality of genomic loci in a population of eukaryotic cells is by use of a functional domain.

Useful in the practice of the instant invention utilizing Group 29 or Group 30 effector protein complexes are methods used in CRISPR-Cas9 systems and reference is made to:

Genome-Scale CRISPR-Cas9 Knockout Screening in Human Cells. Shalem, O., Sanjana, NE., Hartenian, E., Shi, X., Scott, DA., Mikkelson, T., Heckl, D., Ebert, BL., Root, DE., Doench, JG., Zhang, F. Science Dec 12. (2013). [Epub ahead of print]; Published in final edited form as: Science. 2014 Jan. 3; 343(6166): 84-87.

Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hitsNF2, CUL3, TADA2B, and TADA1. The authors observed a high level of consistency between independent guide RNAs targeting the same gene and a high rate of hit confirmation, and thus demonstrated the promise of genome-scale screening with Cas9.

Reference is also made to US patent publication number US20140357530; and PCT Patent Publication WO2014093701, hereby incorporated herein by reference.
Functional Alteration and Screening In another aspect, the present invention provides for a method of functional evaluation and screening of genes/ transcripts (or other RNAs). The use of the CRISPR system of the present invention to precisely deliver functional domains, to activate or repress genes or to alter epigenetic state by precisely altering the methylation site on a specific locus of interest, can be with one or more guide RNAs applied to a single cell or population of cells or with a library applied to genome in a pool of cells ex vivo or in vivo comprising the administration or expression of a library comprising a plurality of guide RNAs (sgRNAs) and wherein the screening further comprises use of a Group 29 or Group 30 effector protein, wherein the CRISPR complex comprising the Group 29 or Group 30 effector protein is modified to comprise a heterologous functional domain. In an aspect the invention provides a method for screening a genome comprising the administration to a host or expression in a host in vivo of a library. In an aspect the invention provides a method as herein discussed further comprising an activator administered to the host or expressed in the host. In an aspect the invention provides a method as herein discussed wherein the activator is attached to a Group 29 or Group 30 effector protein. In an aspect the invention provides a method as herein discussed wherein the activator is attached to the N terminus or the C terminus of the Group 29 or Group 30 effector protein. In an aspect the invention provides a method as herein discussed wherein the activator is attached to a sgRNA loop. In an aspect the invention provides a method as herein discussed further comprising a repressor administered to the host or expressed in the host. In an aspect the invention provides a method as herein discussed, wherein the screening comprises affecting and detecting gene activation, gene inhibition, or cleavage in the locus.

In an aspect, the invention provides efficient on-target activity and minimizes off target activity. In an aspect, the invention provides efficient on-target cleavage by Group 29 or Group 30 effector protein and minimizes off-target cleavage by the Group 29 or Group 30 effector protein. In an aspect, the invention provides guide specific binding of Group 29 or Group 30 effector protein at a gene locus without DNA/RNA cleavage. Accordingly, in an aspect, the invention provides target-specific gene regulation. In an aspect, the invention provides guide specific binding of Group 29 or Group 30 effector protein at a gene locus without DNA/RNA cleavage. Accordingly, in an aspect, the invention provides for cleavage at one gene locus and gene regulation at a different gene locus using a single Group 29 or Group 30 effector protein. In an aspect, the invention provides orthogonal activation and/or inhibition and/or cleavage of multiple targets using one or more Group 29 or Group 30 effector protein and/or enzyme.

In an aspect the invention provides a method as herein discussed, wherein the host is a eukaryotic cell. In an aspect the invention provides a method as herein discussed, wherein the host is a mammalian cell. In an aspect the invention provides a method as herein discussed, wherein the host is a non-human eukaryote. In an aspect the invention provides a method as herein discussed, wherein the non-human eukaryote is a non-human mammal. In an aspect the invention provides a method as herein discussed, wherein the non-human mammal is a mouse. An aspect the invention provides a method as herein discussed comprising the delivery of the Group 29 or Group 30 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein discussed wherein the expressing in vivo is via a lentivirus, an adenovirus, or an AAV. In an aspect the invention provides a method as herein discussed wherein the delivery is via a particle, a particle, a lipid or a cell penetrating peptide (CPP).

In an aspect the invention provides a pair of CRISPR complexes comprising Group 29 or Group 30 effector protein, each comprising a guide RNA (sgRNA) comprising a guide sequence capable of hybridizing to a target sequence in a locus of interest in a cell, wherein at least one loop of each sgRNA is modified by the insertion of distinct RNA sequence(s) that bind to one or more adaptor proteins, and wherein the adaptor protein is associated with one or more functional domains, wherein each sgRNA of each Group 29 or Group 30 effector protein complex comprises a functional domain having a DNA and/or RNA cleavage activity. In an aspect the invention provides paired Group 29 and/or Group 30 effector protein complexes as herein-discussed, wherein the DNA or RNA cleavage activity is due to a Fok1 nuclease.

In an aspect the invention provides a library, method or complex as herein-discussed wherein the sgRNA is modified to have at least one non-coding functional loop, e.g., wherein the at least one non-coding functional loop is repressive; for instance, wherein the at least one non-coding functional loop comprises Alu.

In one aspect, the invention provides a method for altering or modifying expression of a gene product. The said method may comprise introducing into a cell containing and expressing a DNA/RNA molecule encoding the gene product an engineered, non-naturally occurring CRISPR system comprising a Group 29 or Group 30 effector protein and guide RNA that targets the DNA/RNA molecule, whereby the guide RNA targets the DNA/RNA molecule encoding the gene product and the Group 29 or Group 30 effector protein cleaves the DNA/RNA molecule encoding the gene product, whereby expression of the gene product is altered; and, wherein the Group 29 or Group 30 effector protein and the guide RNA do not naturally occur together. The invention comprehends the guide RNA comprising a guide sequence linked to a direct repeat sequence. The invention further comprehends the Group 29 or Group 30 effector protein being codon optimized for expression in a Eukaryotic cell. In a preferred embodiment the Eukaryotic cell is a mammalian cell and in a more preferred embodiment the mammalian cell is a human cell. In a further embodiment of the invention, the expression of the gene product is decreased.

In some embodiments, one or more functional domains are associated with the Group 29 or Group 30 effector protein. In some embodiments, one or more functional domains are associated with an adaptor protein, for example as used with the modified guides of Konnerman et al. (*Nature* 517, 583-588, 29 Jan. 2015). In some embodiments, one or more functional domains are associated with an dead sgRNA (dRNA). In some embodiments, a dRNA complex with active Group 29 or Group 30 effector protein directs gene regulation by a functional domain at on locus while an sgRNA directs DNA/RNA cleavage by the active Group 29 or Group 30 effector protein at another locus, for example as described analogously in CRISPR-Cas9 systems by Dahlman et al., 'Orthogonal gene control with a catalytically active Cas9 nuclease' (in press). In some embodiments, dRNAs are selected to maximize selectivity of regulation for a gene locus of interest compared to off-target regulation. In some embodiments, dRNAs are selected to maximize target gene regulation and minimize target cleavage.

For the purposes of the following discussion, reference to a functional domain could be a functional domain associated with the Group 29 or Group 30 effector protein or a functional domain associated with the adaptor protein.

In some embodiments, the one or more functional domains is an NLS (Nuclear Localization Sequence) or an NES (Nuclear Export Signal). In some embodiments, the one or more functional domains is a transcriptional activation domain comprises VP64, p65, MyoD1, HSF1, RTA, SET7/9 and a histone acetyltransferase. Other references herein to activation (or activator) domains in respect of those associated with the CRISPR enzyme include any known transcriptional activation domain and specifically VP64, p65, MyoD1, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NuE domain, NcoR domain, SID domain or a SID4x domain.

In some embodiments, the one or more functional domains have one or more activities comprising methylase activity, demethylase activity, transcription activation activity, transcription repression activity, transcription release factor activity, histone modification activity, RNA cleavage activity, DNA cleavage activity, DNA integration activity or nucleic acid binding activity.

Histone modifying domains are also preferred in some embodiments. Exemplary histone modifying domains are discussed below. Transposase domains, HR (Homologous Recombination) machinery domains, recombinase domains, and/or integrase domains are also preferred as the present functional domains. In some embodiments, DNA integration activity includes HR machinery domains, integrase domains, recombinase domains and/or transposase domains. Histone acetyltransferases are preferred in some embodiments.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some embodiments, the one or more functional domains is attached to the Group 29 or Group 30 effector protein so that upon binding to the sgRNA and target the functional domain is in a spatial orientation allowing for the functional domain to function in its attributed function.

In some embodiments, the one or more functional domains is attached to the adaptor protein so that upon binding of the Group 29 or Group 30 effector protein to the sgRNA and target, the functional domain is in a spatial orientation allowing for the functional domain to function in its attributed function.

In an aspect the invention provides a composition as herein discussed wherein the one or more functional domains is attached to the Group 29 or Group 30 effector protein or adaptor protein via a linker, optionally a GlySer linker, as discussed herein.

Endogenous transcriptional repression is often mediated by chromatin modifying enzymes such as histone methyltransferases (HMTs) and deacetylases (HDACs). Repressive histone effector domains are known and an exemplary list is provided below. In the exemplary table, preference was given to proteins and functional truncations of small size to facilitate efficient viral packaging (for instance via AAV). In general, however, the domains may include HDACs, histone methyltransferases (HMTs), and histone acetyltransferase (HAT) inhibitors, as well as HDAC and HMT recruiting proteins. The functional domain may be or include, in some embodiments, HDAC Effector Domains, HDAC Recruiter Effector Domains, Histone Methyltransferase (HMT) Effector Domains, Histone Methyltransferase (HMT) Recruiter Effector Domains, or Histone Acetyltransferase Inhibitor Effector Domains.

HDAC Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| HDAC I | HDAC8 | — | — | X. laevis | 325 | 1-325 | 325 | 1-272: HDAC |
| HDAC I | RPD3 | — | — | S. cerevisiae | 433 | 19-340 (Vannier) | 322 | 19-331: HDAC |
| HDAC IV | MesoLo4 | — | — | M. loti | 300 | 1-300 (Gregoretti) | 300 | — |
| HDAC IV | HDAC11 | — | — | H. sapiens | 347 | 1-347 (Gao) | 347 | 14-326: HDAC |
| HD2 | HDT1 | — | — | A. thaliana | 245 | 1-211 (Wu) | 211 | — |
| SIRT I | SIRT3 | H3K9Ac H4K16 Ac H3K56 Ac | — | H. sapiens | 399 | 143-399 (Scher) | 257 | 126-382: SIRT |
| SIRT I | HST2 | — | — | C. albicans | 331 | 1-331 (Hnisz) | 331 | — |
| SIRT I | CobB | — | — | E. coli (K12) | 242 | 1-242 (Landry) | 242 | — |
| SIRT I | HST2 | — | — | S. cerevisiae | 357 | 8-298 (Wilson) | 291 | — |
| SIRT III | SIRT5 | H4K8Ac H4K16 Ac | — | H. sapiens | 310 | 37-310 (Gertz) | 274 | 41-309: SIRT |
| SIRT III | Sir2A | — | — | P. falciparum | 273 | 1-273 (Zhu) | 273 | 19-273: SIRT |
| SIRT IV | SIRT6 | H3K9Ac H3K56 Ac | — | H. sapiens | 355 | 1-289 (Tennen) | 289 | 35-274: SIRT |

Accordingly, the repressor domains of the present invention may be selected from histone methyltransferases (HMNTs), histone deacetylases (THDACs), histone acetyltransferase (HAT) inhibitors, as well as THDAC and HMNT recruiting proteins.

The THDAC domain may be any of those in the table above, namely: HIDAC8, RPD3, MesoLo4, THDAC11, HIDT1, SIRT3, HST2, CobB, HST2, SIRT5, Sir2A, or SIRT6.

In some embodiment, the functional domain may be a THDAC Recruiter Effector Domain. Preferred examples include those in the Table below, namely MeCP2, MBD2b, Sin3a, NcoR, SALLi, RCOR1. NcoR is exemplified in the present Examples and, although preferred, it is envisaged that others in the class will also be useful.

Table of HDAC Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| Sin3a | MeCP2 | — | — | R. norvegicus | 492 | 207-492 (Nan) | 286 | — |
| Sin3a | MBD2b | — | — | H. sapiens | 262 | 45-262 (Boeke) | 218 | — |
| Sin3a | Sin3a | — | — | H. sapiens | 1273 | 524-851 (Laherty) | 328 | 627-829: HDAC1 interaction |
| NcoR | NcoR | — | — | H. sapiens | 2440 | 420-488 (Zhang) | 69 | — |
| NuRD | SALL1 | — | — | M. musculus | 1322 | 1-93 (Lauberth) | 93 | — |

-continued

Table of HDAC Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| CoREST | RCOR1 | — | — | H. sapiens | 482 | 81-300 (Gu, Ouyang) | 220 | — |

In some embodiment, the functional domain may be a Methyltransferase (HMT) Effector Domain. Preferred examples include those in the Table below, namely NUE, vSET, EHMNT2/G9A, SUV39H1, dim-5, KYP, SUVR4, SET4, SETi, SETD8, and TgSET8. NUE is exemplified in the present Examples and, although preferred, it is envisaged that others in the class will also be useful.

Table of Histone Methyltransferase (HMT) Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| SET | NUE | H2B, H3, H4 | — | C. trachomatis | 219 | 1-219 (Pennini) | 219 | — |
| SET | vSET | — | H3K27me3 | P. bursaria chlorella virus | 119 | 1-119 (Mujtaba) | 119 | 4-112: SET2 |
| SUV39 family | EHMT2/ G9A | H1.4K2, H3K9, H3K27 | H3K9me1/2, H1K25me1 | M. musculus | 1263 | 969-1263 (Tachibana) | 295 | 1025-1233: preSET, SET, postSET |
| SUV39 | SUV39H1 | — | H3K9me2/3 | H. sapiens | 412 | 79-412 (Snowden) | 334 | 172-412: preSET, SET, postSET |
| Suvar3-9 | dim-5 | — | H3K9me3 | N. crassa | 331 | 1-331 (Rathert) | 331 | 77-331: preSET, SET, postSET |
| Suvar3-9 (SUVH subfamily) | KYP | — | H3K9me1/2 | A. thaliana | 624 | 335-601 | 267 (Jackson) | — |
| Suvar3-9 (SUVR subfamily) | SUVR4 | H3K9me1 | H3K9me2/3 | A. thaliana | 492 | 180-492 | 313 (Thorstensen) | 192-462: preSET, SET, postSET |
| Suvar4-20 | SET4 | — | H4K20me3 | C. elegans | 288 | 1-288 (Vielle) | 288 | — |
| SET8 | SET1 | — | H4K20me1 | C. elegans | 242 | 1-242 (Vielle) | 242 | — |
| SET8 | SETD8 | — | H4K20me1 | H. sapiens | 393 | 185-393 (Couture) | 209 | 256-382: SET |
| SET8 | TgSET8 | — | H4K20me1/2/3 | T. gondii | 1893 | 1590-1893 (Sautel) | 304 | 1749-1884: SET |

In some embodiment, the functional domain may be a Histone Methyltransferase (TINMT) Recruiter Effector Domain. Preferred examples include those in the Table below, namely Hp 1a, PIHIF 19, and NIPP 1.

Table of Histone Methyltransferase (HMT) Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| — | Hp1a | — | H3K9me3 | M. musculus | 191 | 73-191 | 119 (Hathaway) | 121-179: chromoshadow |

-continued

Table of Histone Methyltransferase (HMT) Recruiter Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | PHF19 | — | H3K27me3 | *H. sapiens* | 580 | (1-250) + GGSG linker + (500-580) | 335 (Ballaré) | 163-250: PHD2 |
| — | NIPP1 | — | H3K27me3 | *H. sapiens* | 351 | 1-329 (Jin) | 329 | 310-329: EED |

In some embodiment, the functional domain may be Histone Acetyltransferase Inhibitor Effector Domain. Preferred examples include SET/TAF-1β listed in the Table below.

Table of Histone Acetyltransferase Inhibitor Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | SET/TAF-1β | — | — | *M. musculus* | 289 | 1-289 (Cervoni) | 289 | — |

It is also preferred to target endogenous (regulatory) control elements (such as enhancers and silencers) in addition to a promoter or promoter-proximal elements. Thus, the invention can also be used to target endogenous control elements (including enhancers and silencers) in addition to targeting of the promoter. These control elements can be located upstream and downstream of the transcriptional start site (TSS), starting from 200 bp from the TSS to 100kb away. Targeting of known control elements can be used to activate or repress the gene of interest. In some cases, a single control element can influence the transcription of multiple target genes. Targeting of a single control element could therefore be used to control the transcription of multiple genes simultaneously.

Targeting of putative control elements on the other hand (e.g. by tiling the region of the putative control element as well as 200 bp up to 100 kB around the element) can be used as a means to verify such elements (by measuring the transcription of the gene of interest) or to detect novel control elements (e.g. by tiling 100kb upstream and downstream of the TSS of the gene of interest). In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence.

Epigenomic target sequence may include, in some embodiments, include a promoter, silencer or an enhancer sequence.

Use of a functional domain linked to a Group 29 or Group 30 effector protein as described herein, preferably a dead-Group 29 or Group 30 effector protein, more preferably a dead-FnGroup 29 or Group 30 effector protein, to target epigenomic sequences can be used to activate or repress promoters, silencer or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6th April 2015).

In some preferred embodiments, the functional domain is linked to a dead-Group 29 or Group 30 effector protein to target and activate epigenomic sequences such as promoters or enhancers. One or more guides directed to such promoters or enhancers may also be provided to direct the binding of the CRISPR enzyme to such promoters or enhancers.

The term "associated with" is used here in relation to the association of the functional domain to the Group 29 or Group 30 effector protein or the adaptor protein. It is used in respect of how one molecule "associates" with respect to another, for example between an adaptor protein and a functional domain, or between the Group 29 or Group 30 effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the Group 29 or Group 30 effector protein or adaptor protein is associated with a functional domain by binding thereto. In other embodiments, the Group 29 or Group 30 effector protein or adaptor protein is associated with a functional domain because the two are fused together, optionally via an intermediate linker.

Functional Screen

In one aspect, the present invention provides for a method of screening for functional elements associated with a change in a phenotype. The library may be introduced into a population of cells that are adapted to contain a Group 29 or Group 30 effector protein. The cells may be sorted into at least two groups based on the phenotype. The phenotype may be expression of a gene, cell growth, or cell viability. The relative representation of the guide RNAs present in each group are determined, whereby genomic sites associated with the change in phenotype are determined by the representation of guide RNAs present in each group. The change in phenotype may be a change in expression of a gene of interest. The gene of interest may be upregulated, downregulated, or knocked out/down. The cells may be sorted into a high expression group and a low expression group. The population of cells may include a reporter construct that is used to determine the phenotype. The reporter construct may include a detectable marker. Cells may be sorted by use of the detectable marker.

In another aspect, the present invention provides for a method of screening for sites associated with resistance to a chemical compound. The chemical compound may be a drug or pesticide. The library may be introduced into a population of cells that are adapted to contain a Group 29 or Group 30 effector protein, wherein each cell of the population contains no more than one guide RNA; the population of cells are treated with the chemical compound; and the representation of guide RNAs are determined after treatment with the chemical compound at a later time point as compared to an early time point, whereby sites associated with resistance to the chemical compound are determined by enrichment of guide RNAs. Representation of sgRNAs may be determined by deep sequencing methods.

Useful in the practice of the instant invention utilizing Group 29 or Group 30 effector protein complexes are methods used in CRISPR-Cas9 systems and reference is made to the article entitled BCL11A enhancer dissection by Cas9-mediated in situ saturating mutagenesis. Canver, M.C., Smith,E.C., Sher, F., Pinello, L., Sanjana, N.E., Shalem, O., Chen, D.D., Schupp, P.G., Vinjamur, D.S., Garcia, S.P., Luc, S., Kurita, R., Nakamura, Y., Fujiwara, Y., Maeda, T., Yuan, G., Zhang, F., Orkin, S.H., & Bauer, D.E. DOI:10.1038/nature15521, published online Sep. 16, 2015, the article is herein incorporated by reference and discussed briefly below:

Canver et al. involves novel pooled CRISPR-Cas9 guide RNA libraries to perform in situ saturating mutagenesis of the human and mouse BCL11A erythroid enhancers previously identified as an enhancer associated with fetal hemoglobin (HbF) level and whose mouse ortholog is necessary for erythroid BCL11A expression. This approach revealed critical minimal features and discrete vulnerabilities of these enhancers. Through editing of primary human progenitors and mouse transgenesis, the authors validated the BCL11A erythroid enhancer as a target for HbF reinduction. The authors generated a detailed enhancer map that informs therapeutic genome editing.

Method of Using Group 29 or Group 30 Systems to Modify a Cell or Organism

The invention in some embodiments comprehends a method of modifying a cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The system may comprise one or more different vectors. In an aspect of the invention, the effector protein is codon optimized for expression of the desired cell type, preferentially a eukaryotic cell, preferably a mammalian cell or a human cell.

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a nucleic acid-targeting system as described herein (such as by transient transfection of one or more vectors, or transfection with RNA), and modified through the activity of a nucleic acid-targeting complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, or rabbit. In certain embodiments, the organism or subject is a plant. In certain embodiments, the organism or subject or plant is algae. Methods for producing transgenic plants and animals are known in the art, and generally begin with a method of cell transfection, such as described herein.

In one aspect, the invention provides for methods of modifying a target polynucleotide in a eukaryotic cell. In some embodiments, the method comprises allowing a nucleic acid-targeting complex to bind to the target polynucleotide to effect cleavage of said target polynucleotide thereby modifying the target polynucleotide, wherein the nucleic acid-targeting complex comprises a nucleic acid-targeting effector protein complexed with a guide RNA hybridized to a target sequence within said target polynucleotide.

In one aspect, the invention provides a method of modifying expression of a polynucleotide in a eukaryotic cell. In some embodiments, the method comprises allowing a nucleic acid-targeting complex to bind to the polynucleotide such that said binding results in increased or decreased expression of said polynucleotide; wherein the nucleic acid-targeting complex comprises a nucleic acid-targeting effector protein complexed with a guide RNA hybridized to a target sequence within said polynucleotide.

Group 29 or Group 30 Effector Protein Complexes can be Used in Plants

The invention in some embodiments comprehends a method of modifying an cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The system may comprise one or more different vectors. In an aspect of the invention, the effector protein is codon optimized for expression the desired cell type, preferentially a eukaryotic cell, preferably a mammalian cell or a human cell.

CRISPR effector protein system(s) (e.g., single or multiplexed) can be used in conjunction with recent advances in crop genomics. Such CRISPR system(s) can be used to perform efficient and cost effective plant gene or genome or transcriptome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. Such CRISPR system(s) can be used with regard to plants in Site-Directed Integration (SDI) or Gene Editing (GE) or any Near Reverse Breeding (NRB) or Reverse Breeding (RB) techniques. With respect to use of the CRISPR systems in plants, mention is made of the University of Arizona website "CRISPR-PLANT" (www.genome.arizona.edu/crispr/) (supported by Penn State and AGI). Emodiments of the invention can be used in genome editing in plants or where RNAi or similar genome editing techniques have been used previously; see, e.g., Nekrasov, "Plant genome editing made easy: targeted mutagenesis in model and crop plants using the CRISPR/Cas system," Plant Methods 2013, 9:39 (doi:10.1186/1746-4811-9-39); Brooks, "Efficient gene editing in tomato in the first generation using the CRISPR/Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi: 10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial Populus reveals 4-coumarate: CoA ligase specificity and Redundancy," New Phytologist (2015) (Forum) 1-4 (available online only at www.newphytologist.com); Caliando et al, "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061-*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," *Nat Rev Genet.* 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applciations, including those mentioned herein.

Sugano et al. (Plant Cell Physiol. 2014 March; 55(3):475-81. doi: 10.1093/pcp/pcu014. Epub 2014 Jan 18) reports the application of CRISPR/Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR/Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR/Cas9-based targeted mutagenesis. The methods of Sugano et al. may be applied to the CRISPR Cas system of the present invention.

Kabadi et al. (Nucleic Acids Res. 2014 Oct. 29; 42(19): e147. doi: 10.1093/nar/gku749. Epub 2014 Aug 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The methods of Kabadi et al. may be applied to the CRISPR Cas system of the present invention.

Xing et al. (BMC Plant Biology 2014, 14:327) developed a CRISPR/Cas9 binary vector set based on the pGreen or pCAMBIA backbone, as well as a gRNA This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA) module vector set, as a toolkit for multiplex genome editing in plants. The toolbox of Xing et al. may be applied to the CRISPR Cas system of the present invention.

Protocols for targeted plant genome editing via CRISPR/Cas9 are also available in volume 1284 of the series Methods in Molecular Biology pp 239-255 10 Feb. 2015. A detailed procedure to design, construct, and evaluate dual gRNAs for plant codon optimized Cas9 (pcoCas9) mediated genome editing using *Arabidopsis thaliana* and *Nicotiana benthamiana* protoplasts s model cellular systems are described. Strategies to apply the CRISPR/Cas9 system to generating targeted genome modifications in whole plants are also discussed. The protocols described in the chapter may be applied to the CRISPR Cas system of the present invention.

Ma et al. (Mol Plant. 2015 Aug. 3; 8(8):1274-84. doi: 10.1016/j.molp.2015.04.007) reports robust CRISPR/Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR/Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in TO rice and T1*Arabidopsis* plants by simultaneous targeting of multiple (up to eight) members of a gene family, multiple genes in a biosynthetic pathway, or multiple sites in a single gene. The methods of Ma et al. may be applied to the CRISPR Cas system of the present invention.

Lowder et al. (Plant Physiol. 2015 Aug 21. pii: pp. 00636.2015) also developed a CRISPR/Cas9 toolbox enables multiplex genome editing and transcriptional regulation of expressed, silenced or non-coding genes in plants. This toolbox provides researchers with a protocol and reagents to quickly and efficiently assemble functional CRISPR/Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, Applicants developed a method for the assembly of Cas9 (WT, nickase or dCas9) and gRNA(s) into a T-DNA destination-vector of interest. The assembly method is based on both Golden Gate assembly and MultiSite Gateway recombination. Three modules are required for assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the CRISPR Cas system of the present invention.

Organisms such as yeast and microalgae are widely used for synthetic biology. Stovicek et al. (Metab. Eng. Comm., 2015; 2:13 describes genome editing of industrial yeast, for example, *Saccharomyces cerevisiae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2-based vector locations. The authors also showed that gene disruption efficiency could be improved by optimization of the levels of Cas9 and gRNA expression. Hlavovi et al. (Biotechnol. Adv.

2015) discusses development of species or strains of microalgae using techniques such as CRISPR to target nuclear and chloroplast genes for insertional mutagenesis and screening.

Petersen ("Towards precisely glycol engineered plants," Plant Biotech Denmark Annual meeting 2015, Copenhagen, Denmark) developed a method of using CRISPR/Cas9 to engineer genome changes in *Arabidopsis*, for example to glyco engineer *Arabidopsis* for production of proteins and products having desired posttranslational modifications. Hebelstrup et al. (Front Plant Sci. 2015 Apr. 23; 6:247) outlines in planta starch bioengineering, providing crops that express starch modifying enzymes and directly produce products that normally are made by industrial chemical and/or physical treatments of starches. The methods of Petersen and Hebelstrup may be applied to the effector protein system of the present invention.

Kurthe et al, *J Virol.* 2012 June; 86(11):6002-9. doi: 10.1128/JVI.00436-12. Epub 2012 Mar 21) developed an RNA virus-based vector for the introduction of desired traits into grapevine without heritable modifications to the genome. The vector provided the ability to regulate expression of endogenous genes by virus-induced gene silencing. The systems and proteins of the instant invention can be used to silence genes and proteins without heritable modification to the genome.

In an embodiment, the plant may be a legume. The present invention may utilize the herein disclosed CRISP-Cas system for exploring and modifying, for example, without limitation, soybeans, peas, and peanuts. Curtin et al. provides a toolbox for legume function genomics. (See Curtin et al., "A genome engineering toolbox for legume Functional genomics," International Plant and Animal Genome Conference XXII 2014). Curtin used the genetic transformation of CRISPR to knock-out/down single copy and duplicated legume genes both in hairy root and whole plant systems. Some of the target genes were chosen in order to explore and optimize the features of knock-out/down systems (e.g., phytoene desaturase), while others were identified by soybean homology to *Arabidopsis* Dicer-like genes or by genome-wide association studies of nodulation in Medicago.

Peanut allergies and allergies to legumes generally are a real and serious health concern. The present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222-228).

In an advantageous embodiment, the plant may be a tree. The present invention may also utilize the herein disclosed CRISPR Cas system for herbaceous systems (see, e.g., Belhaj et al., Plant Methods 9: 39 and Harrison et al., Genes & Development 28: 1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR/Cas9 system was highly sensitive to single nucleotide polymorphisms (SNPs), as cleavage for a third 4CL gene was abolished due to SNPs in the target sequence.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR/Cas9 editing. The *Populus tremula*×alba clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the effector protein system of the present invention.

In plants, pathogens are often host-specific. For example, *Fusarium oxysporum* f. sp. *lycopersici* causes tomato wilt but attacks only tomato, and *F. oxysporum* f *dianthus Puccinia graminis* f. sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

Aside from the plants otherwise discussed herein and above, engineered plants modified by the effector protein and suitable guide, and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide. Any aspect of using classical CRIPSR-Cas systems may be adapted to use in CRISPR systems that are Cas protein agnostic, e.g. Group 29 and Group 30 effector protein systems.

Therapeutic Treatment

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations). Expression of the toxic RNA may be associated with formation of nuclear inclusions and late-onset degenerative changes in brain, heart or skeletal muscle. In the best studied example, myotonic dystrophy, it appears that the main pathogenic effect of the toxic RNA is to sequester binding proteins and compromise the regulation of alternative splicing (Hum. Mol. Genet. (2006) 15 (suppl 2): R162-R169). Myotonic dystrophy [dystrophia myotonica (DM)] is of particular interest to geneticists because it produces an extremely wide range of clinical features. A partial listing would include muscle wasting, cataracts, insulin resistance, testicular atrophy, slowing of cardiac conduction, cutaneous tumors and effects on cognition. The classical form of DM, which is now called DM type 1 (DM1), is caused by an expansion of CTG repeats in the 3'-untranslated region (UTR) of DMPK, a gene encoding a cytosolic protein kinase.

The below table presents a list of exons shown to have misregulated alternative splicing in DM1 skeletal muscle, heart or brain.

| Tissue/gene | Target | Reference |
|---|---|---|
| Skeletal muscle | | |
| ALP | ex 5a, 5b | Lin X., et al. Failure of MBNL1-dependent postnatal splicing transitions in myotonic dystrophy. Hum. Mol. Genet 2006; 15: 2087-2097 |
| CAPN3 | ex 16 | Lin X., et al. Failure of MBNL1-dependent postnatal splicing transitions in myotonic dystrophy. Hum. Mol. Genet 2006; 15: 2087-2097 |
| CLCN1 | int 2, ex 7a, 8a | Mankodi A., et al. Expanded CUG repeats trigger aberrant splicing of CC-1 chloride channel pre-mRNA and hyperexcitability of skeletal muscle in myotonic dystrophy. Mol. Cell 2002; 10: 35-44 Charlet-B N., et al. Loss of the muscle-specific chloride channel in type 1 myotonic dystrophy due to misregulated alternative splicing. Mol. Cell 2002; 10: 45-53 |
| FHOS | ex 11a | Lin X., et al. Failure of MBNL1-dependent postnatal splicing transitions in myotonic dystrophy. Hum. Mol. Genet 2006; 15: 2087-2097 |
| GFAT1 | ex 10 | Lin X., et al. Failure of MBNL1-dependent postnatal splicing transitions in myotonic dystrophy. Hum. Mol. Genet 2006; 15: 2087-2097 |
| IR | ex 11 | Savkur R. S., et al. Aberrant regulation of insulin receptor alternative splicing is associated with insulin resistance in myotonic dystrophy. Nat. Genet. 2001; 29: 40-47 |
| MBNL1 | ex 7 | Lin X., et al. Failure of MBNL1-dependent postnatal splicing transitions in myotonic dystrophy. Hum. Mol. Genet 2006; 15: 2087-2097 |
| MBNL2 | ex 7 | Lin X., et al. Failure of MBNL1-dependent postnatal splicing transitions in myotonic dystrophy. Hum. Mol. Genet 2006; 15: 2087-2097 |
| MTMR1 | ex 2.1, 2.2 | Buj-Bello A., et al. Muscle-specific alternative splicing of myotubularin-related 1 gene is impaired in DM1 muscle cells. Hum. Mol. Genet. 2002; 11: 2297-2307 |
| NRAP | ex 12 | Lin X., et al. Failure of MBNL1-dependent postnatal splicing transitions in myotonic dystrophy. Hum. Mol. Genet 2006; 15: 2087-2097 |
| RYR1 | ex 70 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200 |
| SERCA1 | ex 22 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200 Lin X., et al. Failure of MBNL1-dependent postnatal splicing transitions in myotonic dystrophy. Hum. Mol. Genet 2006; 15: 2087-2097 |
| z-Titin | ex Zr4, Zr5 | Lin X., et al. Failure of MBNL1-dependent postnatal splicing transitions in myotonic dystrophy. Hum. Mol. Genet 2006; 15: 2087-2097 |
| m-Titin | M-line ex5 | Lin X., et al. Failure of MBNL1-dependent postnatal splicing transitions in myotonic dystrophy. Hum. Mol. Genet 2006; 15: 2087-2097 |
| TNNT3 | fetal ex | Kanadia R. N. et al. A muscleblind knockout model for myotonic dystrophy. Science 2003; 302: 1978-1980 |
| ZASP | ex 11 | Lin X., et al. Failure of MBNL1-dependent postnatal splicing transitions in myotonic dystrophy. Hum. Mol. Genet 2006; 15: 2087-2097 |
| Heart | | |
| TNNT2 | ex 5 | Philips A. V., et al. Disruption of splicing regulated by a CUG-binding protein in myotonic dystrophy. Science 1998; 280: 737-741 |
| ZASP | ex 11 | Mankodi A., et al. Nuclear RNA foci in the heart in myotonic dystrophy. Circ. Res. 2005; 97: 1152-1155 |
| m-Titin | M-line ex 5 | Mankodi A., et al. Nuclear RNA foci in the heart in myotonic dystrophy. Circ. Res. 2005; 97: 1152-1155 |
| KCNAB1 | ex 2 | Mankodi A., et al. Nuclear RNA foci in the heart in myotonic dystrophy. Circ. Res. 2005; 97: 1152-1155 |

-continued

| Tissue/gene | Target | Reference |
|---|---|---|
| ALP | ex 5 | (Mankodi A., et al. Nuclear RNA foci in the heart in myotonic dystrophy. Circ. Res. 2005; 97: 1152-1155 |
| | | Brain |
| TAU | ex 2, ex 10 | Sergeant N., et al. Dysregulation of human brain microtubule-associated tau mRNA maturation in myotonic dystrophy type 1. Hum. Mol. Genet. 2001; 10: 2143-2155 |
| | | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |
| APP | ex 7 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |
| NMDAR1 | ex 5 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |

The enzymes of the present invention may target overexpressed RNA or toxic RNA, such as for example, the DMPK gene or any of the misregulated alternative splicing in DM1 skeletal muscle, heart or brain in, for example, the above table.

The enzymes of the present invention may also target trans-acting mutations affecting RNA-dependent functions that cause disease (summarized in Cell. 2009 Feb. 20; 136(4): 777-793) as indicated in the below table.

| DISEASE | GENE/MUTATION | FUNCTION |
|---|---|---|
| Prader Willi syndrome | SNORD116 | ribosome biogenesis |
| Spinal muscular atrophy (SMA) | SMN2 | splicing |
| Dyskeratosis congenita (X-linked) | DKC1 | telomerase/translation |
| Dyskeratosis congenita (autosomal dominant) | TERC | telomerase |
| Dyskeratosis congenita (autosomal dominant) | TERT | telomerase |
| Diamond-Blackfan anemia | RPS19, RPS24 | ribosome biogenesis |
| Shwachman-Diamond syndrome | SBDS | ribosome biogenesis |
| Treacher-Collins syndrome | TCOF1 | ribosome biogenesis |
| Prostate cancer | SNHG5 | ribosome biogenesis |
| Myotonic dystrophy, type 1 (DM1) | DMPK (RNA gain-of-function) | protein kinase |
| Myotonic dystrophy type 2 (DM2) | ZNF9 (RNA gain-of-function) | RNA binding |
| Spinocerebellar ataxia 8 (SCA8) | ATXN8/ATXN8OS (RNA gain-of-function) | unknown/noncoding RNA |
| Huntington's disease-like 2 (HDL2) | JPH3 (RNA gain-of-function) | ion channel function |
| Fragile X-associated tremor ataxia syndrome (FXTAS) | FMR1 (RNA gain-of-function) | translation/mRNA localization |
| Fragile X syndrome | FMR1 | translation/mRNA localization |
| X-linked mental retardation | UPF3B | translation/nonsense mediated decay |
| Oculopharyngeal muscular dystrophy (OPMD) | PABPN1 | 3' end formation |
| Human pigmentary genodermatosis | DSRAD | editing |
| Retinitis pigmentosa | PRPF31 | splicing |
| Retinitis pigmentosa | PRPF8 | splicing |
| Retinitis pigmentosa | HPRP3 | splicing |
| Retinitis pigmentosa | PAP1 | splicing |
| Cartilage-hair hypoplasia (recessive) | RMRP | splicing |
| Autism | 7q22-q33 locus breakpoint | noncoding RNA |
| Beckwith-Wiedemann syndrome (BWS) | H19 | noncoding RNA |
| Charcot-Marie-Tooth (CMT) Disease | GRS | translation |
| Charcot-Marie-Tooth (CMT) Disease | YRS | translation |
| Amyotrophic lateral sclerosis (ALS) | TARDBP | splicing, transcription |
| Leukoencephalopathy with vanishing white matter | EIF2B1 | translation |
| Wolcott-Rallison syndrome | EIF2AK3 | translation (protease) |
| Mitochondrial myopathy and sideroblastic anemia (MLASA) | PUS1 | translation |
| Encephalomyopathy and hypertrophic | TSFM | translation |

-continued

| DISEASE | GENE/MUTATION | FUNCTION |
| --- | --- | --- |
| cardiomyopathy | | (mitochondrial) |
| Hereditary spastic paraplegia | SPG7 | ribosome biogenesis |
| Leukoencephalopathy | DARS2 | translation (mitochondrial) |
| Susceptibility to diabetes mellitus | LARS2 | translation (mitochondrial) |
| Deafness | MTRNR1 | ribosome biogenesis (mitochondrial) |
| MELAS syndrome, deafness | MTRNR2 | ribosome biogenesis (mitochondrial) |
| Cancer | SFRS1 | splicing, translation, export |
| Cancer | RBM5 | splicing |
| Multiple disorders | mitochondrial tRNA mutations | translation (mitochondrial) |
| Cancer | miR-17-92 cluster | RNA interference |
| Cancer | miR-372/miR-373 | RNA interference |

The enzyme of the present invention may also be used in the treatment of various tauopathies, including primary and secondary tauopathies, such as primary age-related tauopathy (PART)/Neurofibrillary tangle-predominant senile dementia, with NFTs similar to AD, but without plaques, dementia pugilistica (chronic traumatic encephalopathy), progressive supranuclear palsy, corticobasal degeneration, frontotemporal dementia and parkinsonism linked to chromosome 17, lytico-Bodig disease (Parkinson-dementia complex of Guam), ganglioglioma and gangliocytoma, meningioangiomatosis, postencephalitic parkinsonism, subacute sclerosing panencephalitis, as well as lead encephalopathy, tuberous sclerosis, Hallervorden-Spatz disease, and lipofuscinosis, alzheimers disease. The enzymes of the present invention may also target mutations disrupting the cis-acting splicing code cause splicing defects and disease (summarized in Cell. 2009 Feb. 20; 136(4): 777-793). The motor neuron degenerative disease SMA results from deletion of the SMN1 gene. The remaining SMN2 gene has a C→T substitution in exon 7 that inactivates an exonic splicing enhancer (ESE), and creates an exonic splicing silencer (ESS), leading to exon 7 skipping and a truncated protein (SMNΔ7). A T→A substitution in exon 31 of the dystrophin gene simultaneously creates a premature termination codon (STOP) and an ESS, leading to exon 31 skipping. This mutation causes a mild form of DMD because the mRNA lacking exon 31 produces a partially functional protein. Mutations within and downstream of exon 10 of the MAPT gene encoding the tau protein affect splicing regulatory elements and disrupt the normal 1:1 ratio of mRNAs including or excluding exon 10. This results in a perturbed balance between tau proteins containing either four or three microtubule-binding domains (4R-tau and 3R-tau, respectively), causing the neuropathological disorder FTDP-17. The example shown is the N279K mutation which enhances an ESE function promoting exon 10 inclusion and shifting the balance toward increased 4R-tau. Polymorphic (UG)m(U)n tracts within the 3' splice site of the CFTR gene exon 9 influence the extent of exon 9 inclusion and the level of full-length functional protein, modifying the severity of cystic fibrosis (CF) caused by a mutation elsewhere in the CFTR gene.

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs.

The RNA targeting effector protein of the invention can further be used for antiviral activity, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent.

Therapeutic dosages of the enzyme system of the present invention to target RNA the above-referenced RNAs are contemplated to be about 0.1 to about 2 mg/kg the dosages may be administered sequentially with a monitored response, and repeated dosages if necessary, up to about 7 to 10 doses per patient. Advantageously, samples are collected from each patient during the treatment regimen to ascertain the effectiveness of treatment. For example, RNA samples may be isolated and quantified to determine if expression is reduced or ameliorated. Such a diagnostic is within the purview of one of skill in the art.

Transcript Detection Methods

The effector proteins and systems of the invention are useful for specific detection of RNAs in a cell or other sample. In the presence of an RNA target of interest, guide-dependent Cas13b nuclease activity may be accompanied by non-specific RNAse activity against collateral targets. To take advantage of the RNase activity, all that is needed is a reporter substrate that can be detectably cleaved. For example, a reporter molecule can comprise RNA, tagged with a fluorescent reporter molecule (fluor) on one end and a quencher on the other. In the absence of Cas13b RNase activity, the physical proximity of the quencher dampens fluorescence from the fluor to low levels. When Cas13b target specific cleavge is activated by the presence of an RNA target-of-interest and suitable guide RNA, the RNA-containing reporter molecule is non-specifically cleaved and the fluor and quencher are spatially separated. This causes the fluor to emit a detectable signal when excited by light of the appropriate wavelength.

In one exemplary assay method, Cas13b effector, target-of-interest-specific guide RNA, and reporter molecule are added to a cellular sample. An increase in fluorescence indicates the presence of the RNA target-of-interest. In another exemplary method, a detection array is provided.

Each location of the array is provided with Cas13b effector, reporter molecule, and a target-of-interest-specific guide RNA. Depending on the assay to be performed, the target-of-interest-specific guide RNAs at each location of the array can be the same, different, or a combination thereof. Different target-of-interest-specific guide RNAs might be provided, for example when it is desired to test for one or more targets in a single source sample. The same target-of-interest-specific guide RNA might be provided at each location, for example when it is desired to test multiple samples for the same target.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents EP 2 784 162 B1 and EP 2 771 468 B1; European Patent Applications EP 2 771 468 (EP13818570.7), EP 2 764 103 (EP13824232.6), and EP 2 784 162 (EP14170383.5); and PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809). Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014 6/10/14; PCT/US2014/041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed April 15,2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013.

Mention is also made of U.S. application 62/091,455, filed, 12-Dec-14, PROTECTED GUIDE RNAS (PGRNAS); U.S. application 62/096,708, 24-Dec-14, PROTECTED GUIDE RNAS (PGRNAS); U.S. application 62/091,462, 12-Dec-14, DEAD GUIDES FOR CRISPR TRANSCRIPTION FACTORS; U.S. application 62/096,324, 23-Dec-14, DEAD GUIDES FOR CRISPR TRANSCRIPTION FACTORS; U.S. application 62/091,456, 12-Dec-14, ESCORTED AND FUNCTIONALIZED GUIDES FOR CRISPR-CAS SYSTEMS; U.S. application 62/091,461, 12-Dec-14, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19-Dec-14, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24-Dec-14, ENGINEERING OF SYSTEMS, METHODS AND OPTIMIZED ENZYME AND GUIDE SCAFFOLDS FOR SEQUENCE MANIPULATION; U.S. application 62/098,059, 30-Dec-14, RNA-TARGETING SYSTEM; U.S. application 62/096,656, 24-Dec-14, CRISPR HAVING OR ASSOCIATED WITH DESTABILIZATION DOMAINS; U.S. application 62/096,697, 24-Dec-14, CRISPR HAVING OR ASSOCIATED WITH AAV; U.S. application 62/098,158, 30-Dec-14, ENGINEERED CRISPR COMPLEX INSERTIONAL TARGETING SYS- TEMS; U.S. application 62/151,052, 22-Apr-15, CELLULAR TARGETING FOR EXTRACELLULAR EXOSOMAL REPORTING; U.S. application 62/054,490, 24-Sep-14, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 62/055,484, 25-Sep-14, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4-Dec-14, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24-Sep-14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23-Oct-14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24-Sep-14, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24-Sep-14, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25-Sep-14, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25-Sep-14, MULTIFUNCTIONAL-CRISPR COMPLEXES AND/OR OPTIMIZED ENZYME LINKED FUNCTIONAL-CRISPR COMPLEXES; U.S. application 62/087,475, 4-Dec-14, FUNCTIONAL SCREENING WITH OPTIMIZED FUNCTIONAL CRISPR-CAS SYSTEMS; U.S. application 62/055,487, 25-Sep-14, FUNCTIONAL SCREENING WITH OPTIMIZED FUNCTIONAL CRISPR-CAS SYSTEMS; U.S. application 62/087,546, 4-Dec-14, MULTIFUNCTIONAL CRISPR COMPLEXES AND/OR OPTIMIZED ENZYME LINKED FUNCTIONAL-CRISPR COMPLEXES; and U.S. application 62/098,285, 30-Dec-14, CRISPR MEDIATED IN VIVO MODELING AND GENETIC SCREENING OF TUMOR GROWTH AND METASTASIS.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

Multiplex genome engineering using CRISPR/Cas systems. Cong, L., Ran, F.A., Cox, D., Lin, S., Barretto, R., Habib, N., Hsu, P.D., Wu, X., Jiang, W., Marraffini, L.A., & Zhang, F. Science Feb 15; 339(6121):819-23 (2013);

RNA-guided editing of bacterial genomes using CRISPR-Cas systems. Jiang W., Bikard D., Cox D., Zhang F, Marraffini L A. Nat Biotechnol Mar; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich *M*, Cong L, Platt R J, Scott D A, Church G M, Zhang F. Nature. Aug 22; 500(7463):472-6. doi: 10.1038/Nature12466. Epub 2013 Aug 23 (2013);

Double Nicking by RNA-Guided CRISPR Cas9 for Enhanced Genome Editing Specificity. Ran, FA., Hsu, PD., Lin, CY., Gootenberg, JS., Konermann, S., Trevino, AE., Scott, DA., Inoue, A., Matoba, S., Zhang, Y., & Zhang, F. Cell Aug 28. pii: S0092-8674(13)01015-5 (2013-A);

DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, TJ., Marraffini, LA., Bao, G., & Zhang, F. *Nat Biotechnol* doi:10.1038/nbt.2647 (2013);

Genome engineering using the CRISPR-Cas9 system. Ran, FA., Hsu, PD., Wright, J., Agarwala, V., Scott, DA., Zhang, F. Nature Protocols Nov; 8(11):2281-308 (2013-B);

Genome-Scale CRISPR-Cas9 Knockout Screening in Human Cells. Shalem, O., Sanjana, NE., Hartenian, E., Shi, X., Scott, DA., Mikkelson, T., Heckl, D., Ebert, BL., Root, DE., Doench, JG., Zhang, F. Science Dec 12. (2013). [Epub ahead of print];

Crystal structure of cas9 in complex with guide RNA and target DNA. Nishimasu, H., Ran, FA., Hsu, PD., Konermann, S., Shehata, SI., Dohmae, N., Ishitani, R., Zhang, F., Nureki, O. Cell Feb 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. Apr 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas 0, Eisenhaure™, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. Jun 5; 157(6):1262-78 (2014);

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. Dec; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. Jan; 33(1):102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. Jan 29; 517(7536):583-8 (2015);

A split-Cas9 architecture for inducible genome editing and transcription modulation, Zetsche B, Volz S E, Zhang F., (published online 2 Feb. 2015) Nat Biotechnol. Feb; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. Apr 9; 520 (7546):186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015).

Nishimasu et al., Crystal Structure of Staphylococcus aureus Cas9," Cell 162, 1113-1126 (Aug. 27, 2015).

Zetsche et al., "Cpf1 Is a Single RNA-Guided Endonuclease of a Class 2 CRISPR-Cas System," Cell 163, 1-13 (Oct. 22, 2015).

Shmakov et al., "Discovery and Functional Characterization of Diverse Class 2 CRISPR-Cas Systems," Molecular Cell 60, 1-13 (Available online Oct. 22, 2015).

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of Streptococcuspneumoniae and *Escherichia co/i*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors.

Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knock-out (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity. End Edits Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Zetsche et al. (2015) reported the characterization of Cpf1, a putative class 2 CRISPR effector. It was demonstrated that Cpf1 mediates robust DNA interference with features distinct from Cas9. Identifying this mechanism of interference broadens our understanding of CRISPR-Cas systems and advances their genome editing applications.

Shmakov et al. (2015) reported the characterization of three distinct Class 2 CRISPR-Cas systems. The effectors of two of the identified systems, C2c1 and C2c3, contain RuvC like endonuclease domains distantly related to Cpf1. The third system, C2c2, contains an effector with two predicted HEPN RNase domains.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In addition, mention is made of PCT application PCT/US14/70057, entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30° C., e.g., 20-25° C., e.g., room temperature, for a suitable time, e.g., 15-45, such as 30 minutes, advantageously in sterile, nuclease free buffer, e.g., 1× PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a $C_{1-6}$ alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP: DMPC: PEG: Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising sgRNA and/or Cas9 as in the instant invention and components that form a particle, e.g., as in the Particle Delivery PCT, to form a particle and particles from such admixing (or, of course, other particles involving sgRNA and/or Cas9 as in the instant invention).

The present invention will be further illustrated in the following Examples which are given for illustration purposes only and are not intended to limit the invention in any way.

EXAMPLES

Example 1: An Expanded Search for RNA Programmable Genomic Engineering Effectors Cas9 is an RNA-programmable endonuclease associated with CRISPRs found in prokaryotes that has transformed biology. Recently additional unique candidates for RNA-programmable single effectors have been discovered, and in one case validated (e.g. Cpf1), based on proximity to CRISPR-associated Cas1 and Cas2 proteins. The work described in the present application expands this search with the aim of exhausting the possibility space for RNA-programmable CRISPR single effectors in a full and up-to-date genomic dataset.

Background: The discovery of the CRISPR/Cas9 endonuclease system found near CRISPRs (clustered regularly interspaced short palindromic repeats) of prokaryotes has radically transformed biology. CRISPR systems composed of CRISPR arrays and CRISPR-associated proteins confer adaptive immunity to bacteria and archaea against invading bacteriophages (Makarova et al., 2011; 2015). By reengineering CRISPR systems, in the span of a few years it has become possible to modify precisely the genome of an organism on a system level (Ran et al., 2015).

CRISPR arrays contain spacer sequences acquired from bacteriophage DNA separated by repeat sequences for array processing. The CRISPR-associated Cas9 protein operates by recruiting a crRNA from the CRISPR array and a tracrRNA nearby the array to cleave DNA and induce a double strand break at a specific programmable sequence, encoded by an N-base pair target sequence and short adjacent M-base pair protospacer adjacent motif (PAM), with N, M, and the sequence of the PAM varying among species (Chylinski et al., 2013; Fonfara et al., 2014).

Unlike multi-effector CRISPR systems, Type II CRISPR systems rely on the single effector Cas9 (Chylinski et al., 2014). Thus, precise genome engineering can be achieved with a minimal two-component system: the Cas9 protein and a modified sgRNA (unimolecular combination of tracrRNA and crRNA).

Several new single-effector CRISPR systems with effectors distinct from Cas9 have recently been discovered through a bioinformatic search of single large effectors proximate to Cas1 and Cas2, two small proteins implicated in CRISPR spacer acquisition (Shmakov et al., submitted 2015). In addition, Cpf1, a protein previously identified but whose function had not yet been elucidated, has been found to operate analogously to Cas9, but without the use of a tracrRNA (Zetsche et al., submitted 2015). It is hypothesized that there may be yet more single-effector systems to discover, with DNA-targeting, RNA-targeting, or perhaps even DNA integrating or transposing capabilities inherited from a common evolutionary origin (Koonin & Krupovic, 2015).

Prior to the present invention, a CRISPR-associated protein-agnostic approach to identify novel single-effector systems was not available. As described in detail below, the present invention provides a bioinformatic pipeline for discovery of novel Class 2 CRISPR systems excluding Cas1 and Cas2. Beyond uncovering new biology, the invention provides means to identify an RNA-guided single effector for translation into a useful genomic engineering tool through the following steps:

1) computationally classifying new single-effector systems; and
2) experimentally following up to expand genome engineering capabilities.

Computational Procedure: A biocomputational pipeline was designed and implemented to mine through metagenomics datasets for novel Class 2 CRISPR single effectors, akin to the revolutionary genome-engineering tools Cas9 and Cpf1. Whereas previous search strategies relied on protein proximity to CRISPR-associated spacer acquisition proteins Cas1 and Cas2, this approach was seeded on CRISPR arrays alone. What resulted was the discovery of a potential new Class 2 CRISPR system, with two subtypes as characterized by distinct putative accessory proteins.

The implementation of the computational procedure has already yielded a few novel potential single-effector systems. FIG. 1 depicts the basic workflow. First, all prokaryotic genomes are downloaded (the European Ensembl and American NCBI databases contain the largest publicly accessible repositories). Second, the PILER-CR CRISPR array discovery algorithm is run on all genomes with default settings to store all possible CRISPR arrays in data (Edgar, 2007). Third, nearby proteins within 10 kilobase pairs of discovered arrays are stored in data. Fourth, in a single-effector filter, all systems with no nearby protein greater than 700 amino acids or more than one nearby protein greater than 700 amino acids are filtered out. Additionally, only systems with a large single effector between 900 and 1800 amino acids-informed by functionality and compatibility considerations—are chosen. Fifth, these proteins are subjected to an NCBI BLAST homology search against the entire NCBI protein database to identify homologous proteins, and HHpred protein domain homology searches are conducted on all homologous proteins found (Soding et al., 2005). From all data and the literature, genomic loci are visualized. The candidate list was limited to families in which the putative effector was near a CRISPR array in at least 50% of the members to focus on potentially functional CRISPR loci.

FIG. 2 shows overall preliminary data from an input of Ensembl Genomes Release 27, with the number of arrays and large proteins discovered graphed according to category (all arrays vs. single large effector arrays; arrays with varying combinations of Cas1 and Cas2 proximate). The pertinent value for the proposed research is the number of large proteins in single large effector arrays with neither Cas1 nor Cas 2 proximate, namely 1,531.

These large single effectors in systems lacking Cas1 and Cas2 were subjected to an NCBI BLAST homology search with an E-value cutoff of 1e-7 against the entire NCBI protein database to identify homologous proteins (Camacho et al., 2009). HHpred protein domain homology searches were conducted on all proteins found in this manner (Soding et al., 2005).

Figure 3:
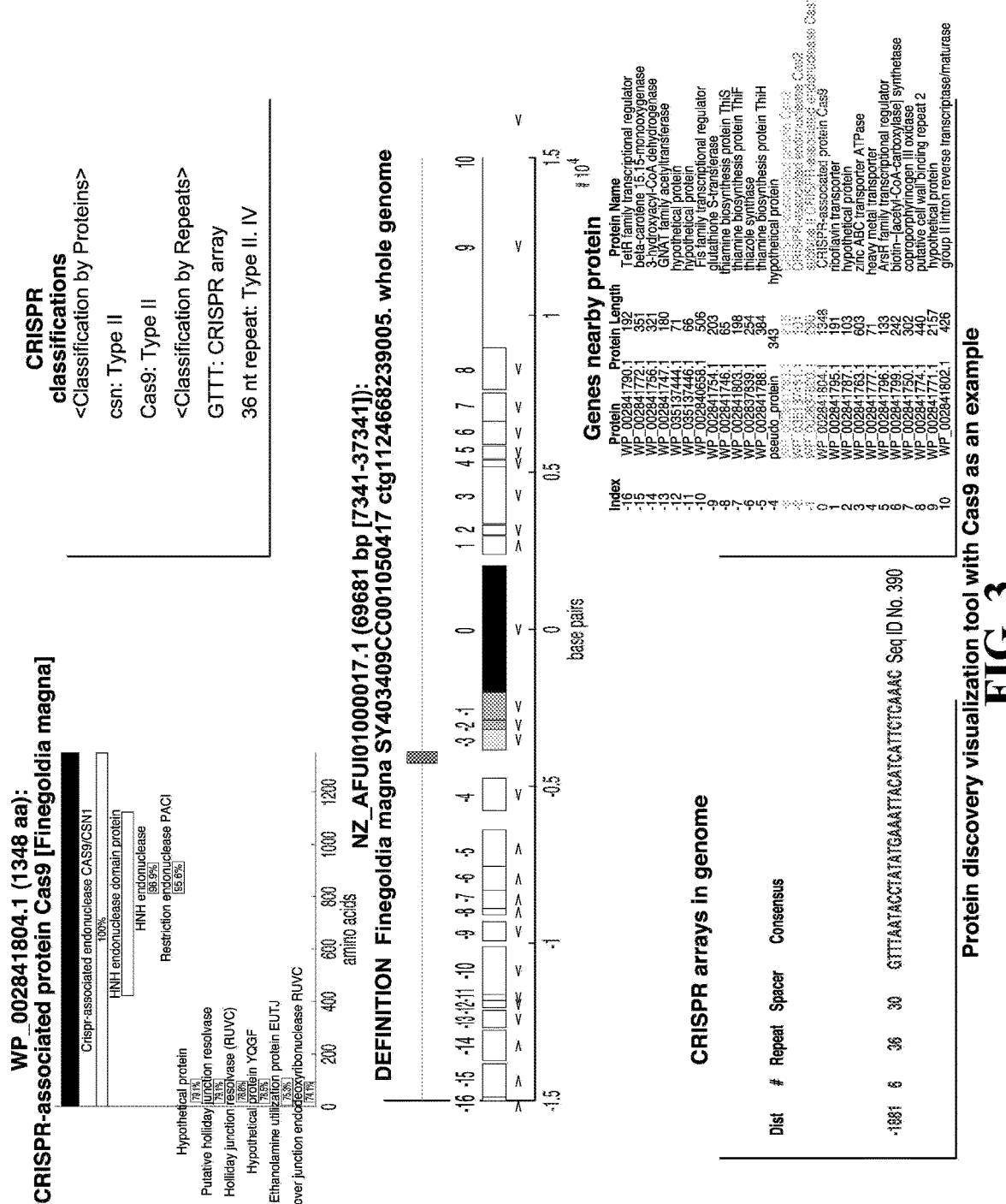
FIG. 3 provides a protein discovery visualization tool with Cas9 example. (Top left) Select protein accession number, length, and name above top 10 HHpred homology hits and their respective probabilities. (Top right) Tentative CRISPR classifications based on existing literature. (Middle) Genome accession number, length, range, and name above graph of genomic locus containing CRISPR array in red and proteins in blue (selected protein), magenta (annotated Cas1, Cas 2), orange (other annotated CRISPR associated proteins), and white (all other proteins) with protein orientations depicted. Arrows below the graph dictate predicted direction of transcription (5' to 3'). Numbers above graph represent kilobase distance from selected protein with negative numbers indicating "downstream" and positive numbers indicating "upstream." (Bottom left) CRISPR arrays in genome with distance from select protein (negative if downstream of protein), number of repeats, length of repeats, length of spacers, and consensus repeat sequence. (SEQ ID NO: 390). (Bottom right) Key of genes nearby select proteins with index, accession number, length in amino acids, and name.
Figure 4A:
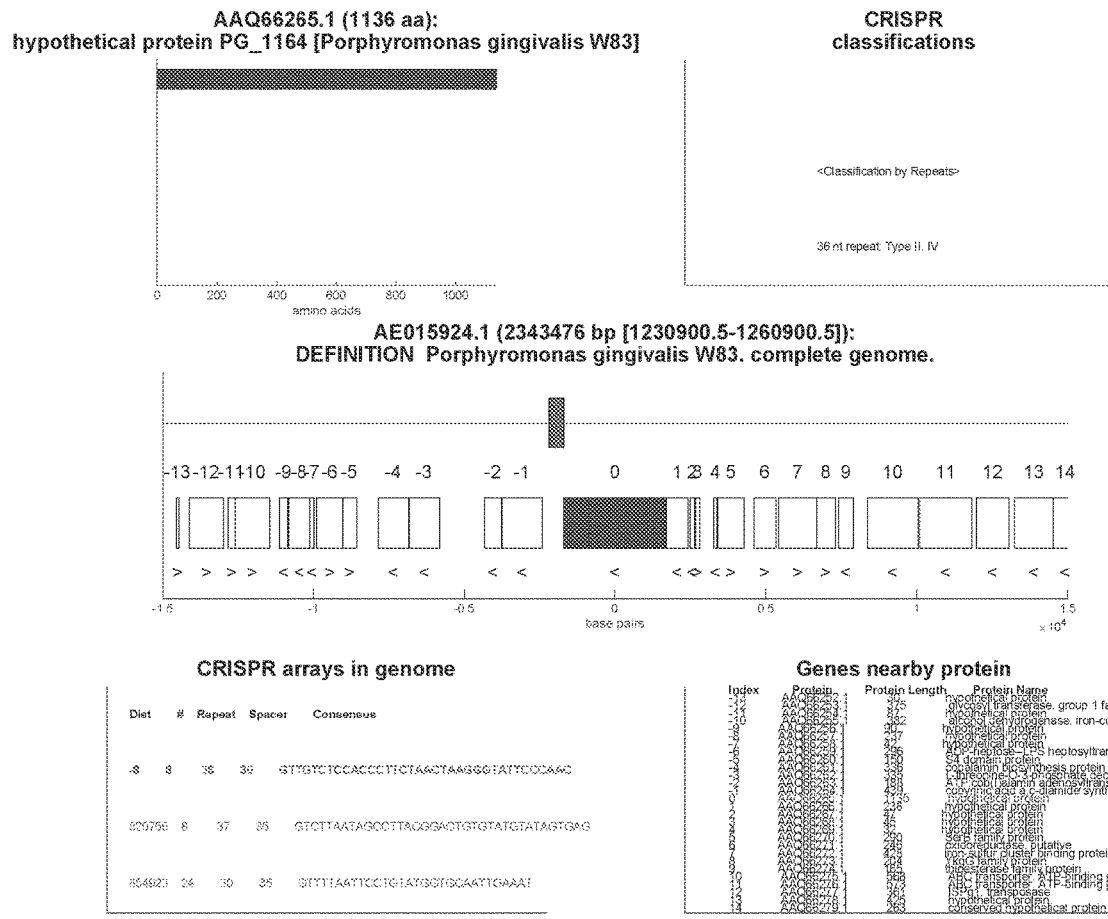
FIGS. 4A-4M show output of bioinformatic pipeline that discovered Group 29 proteins (refer to FIG. 3 legend for explanation of files). Proteins were further discovered by NCBI BLAST and then grouped by homology with a nearest neighbor E-value minimum cutoff of 1e-7 among all proteins. Most proteins have one small accessory protein. (SEQ ID Nos. 391 through 608).
Figure 4B:
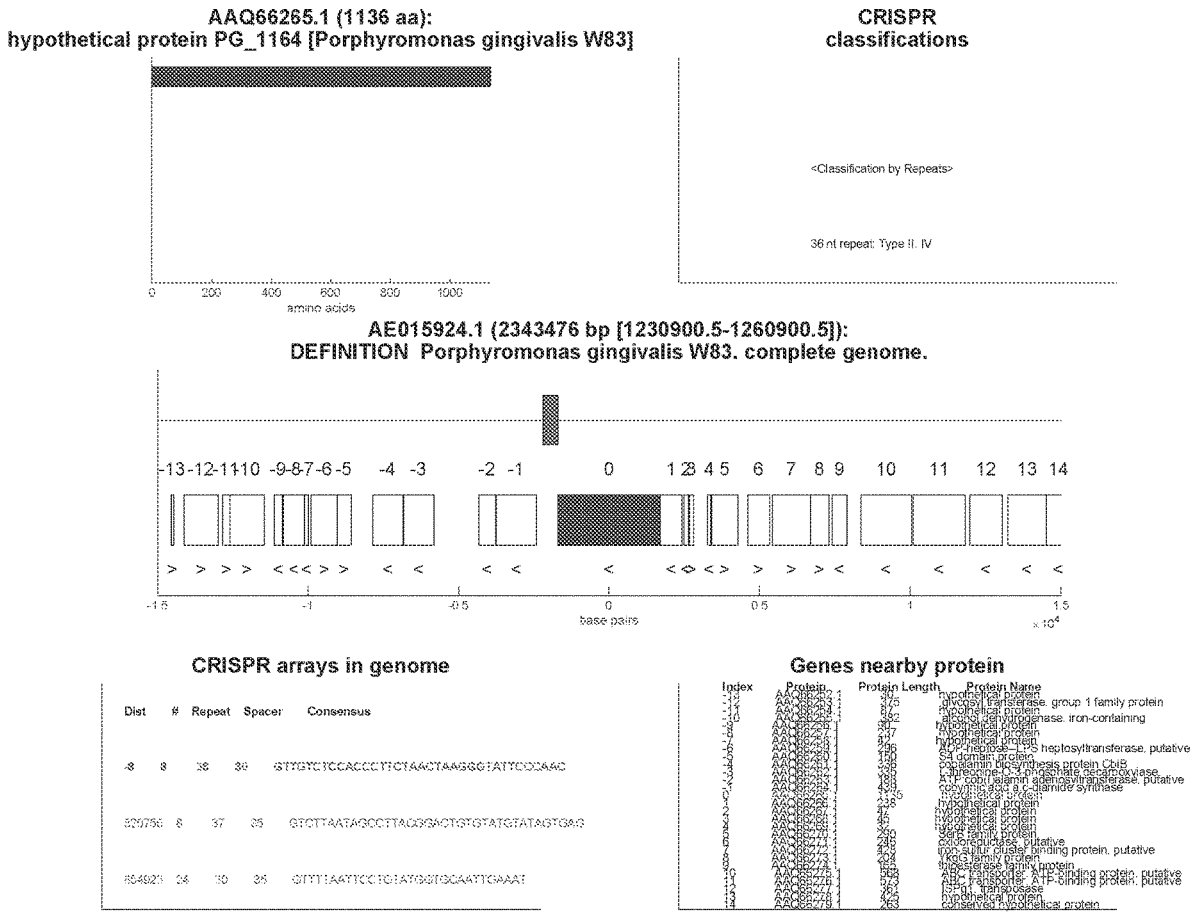
Figure 4D:
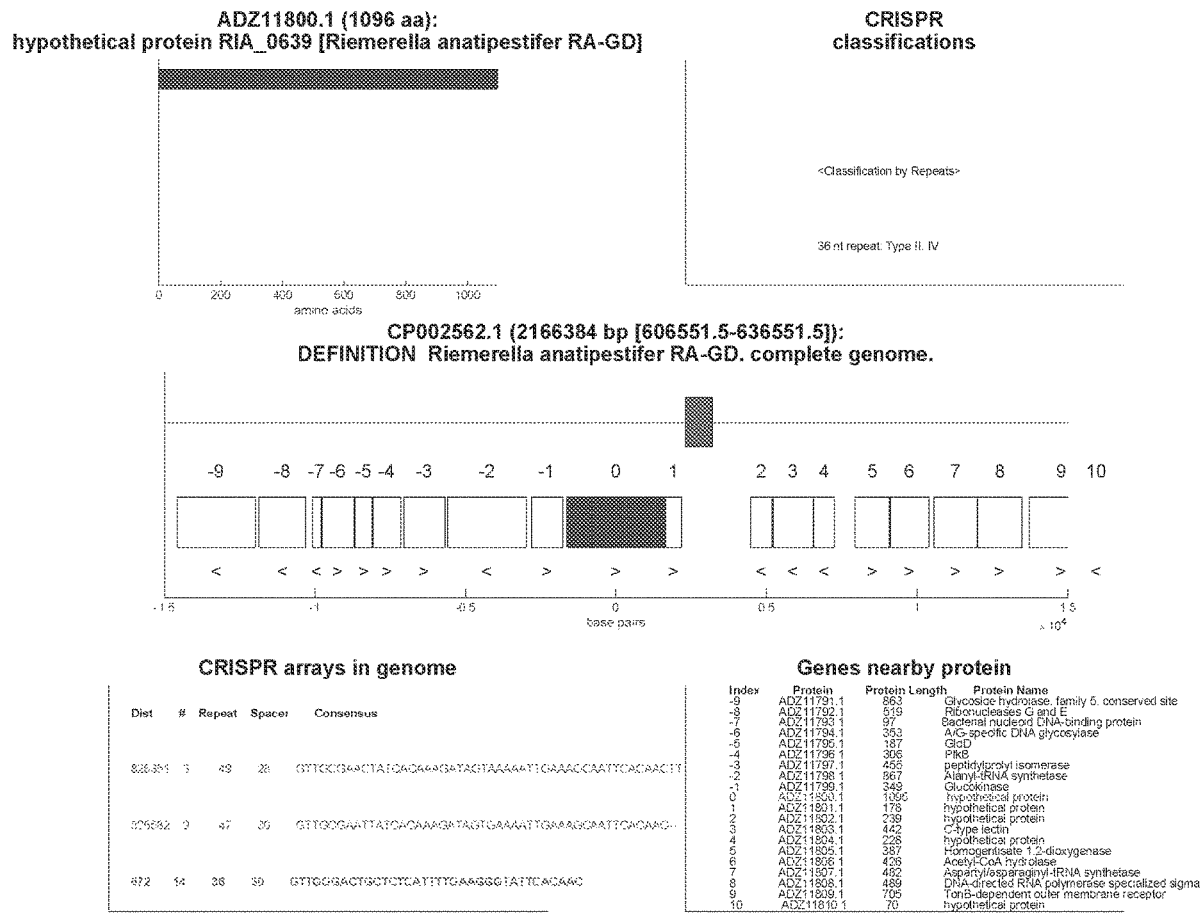
Figure 4E:
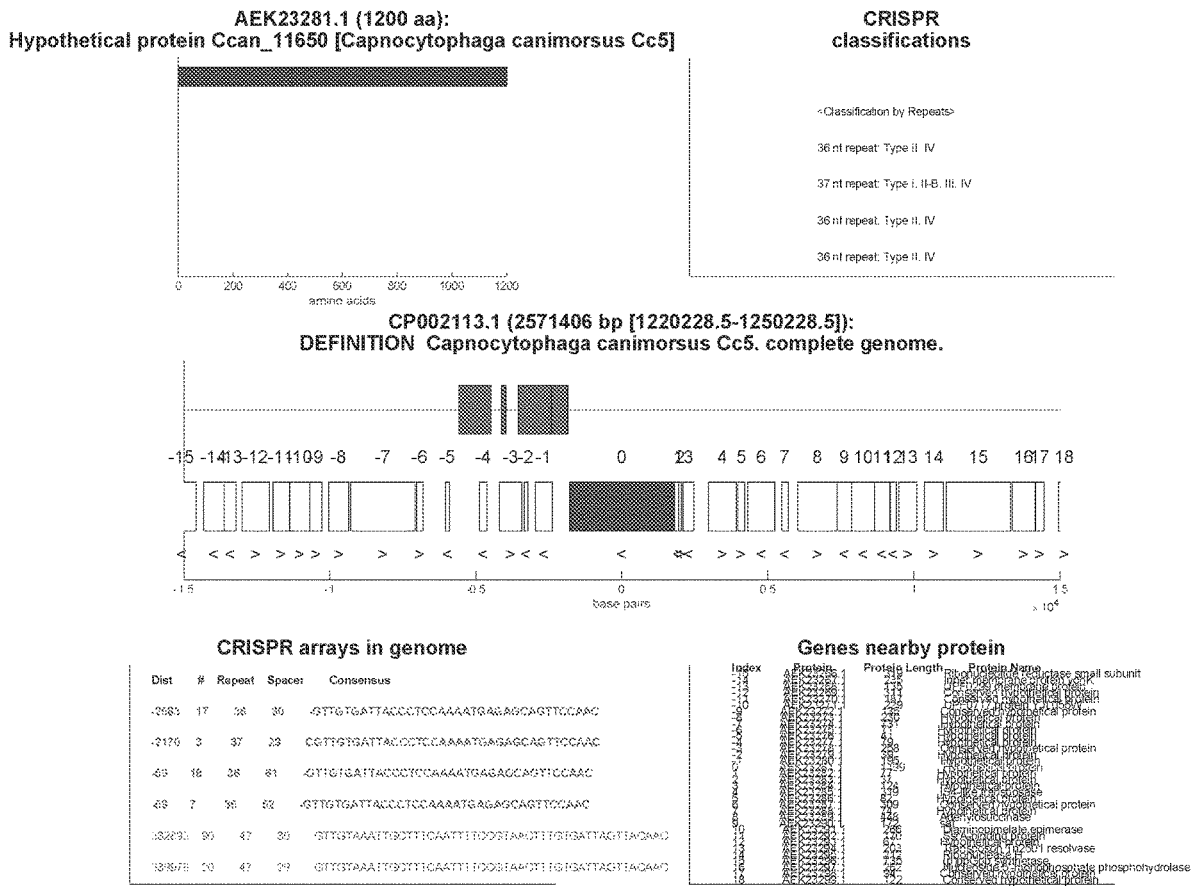
Figure 4F:
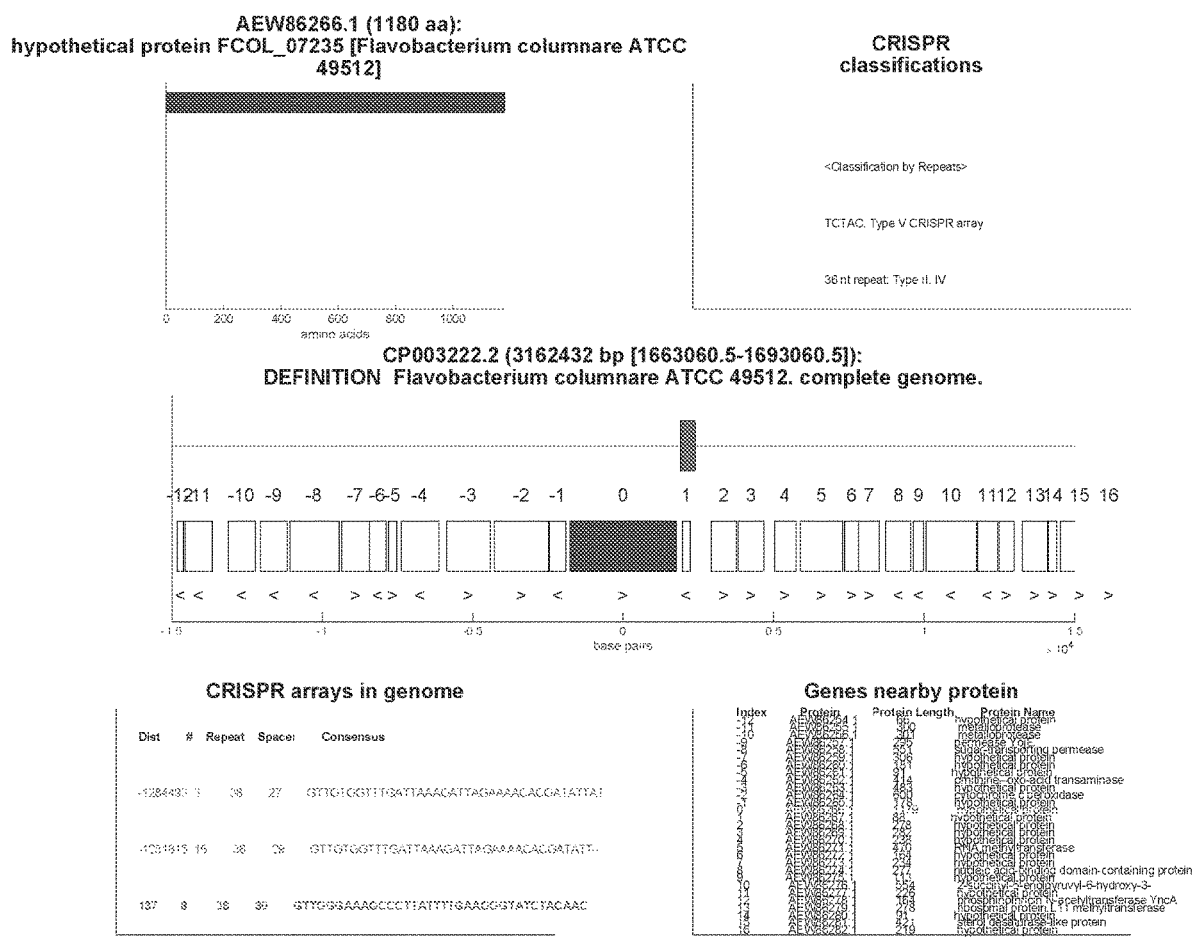
Figure 4H:
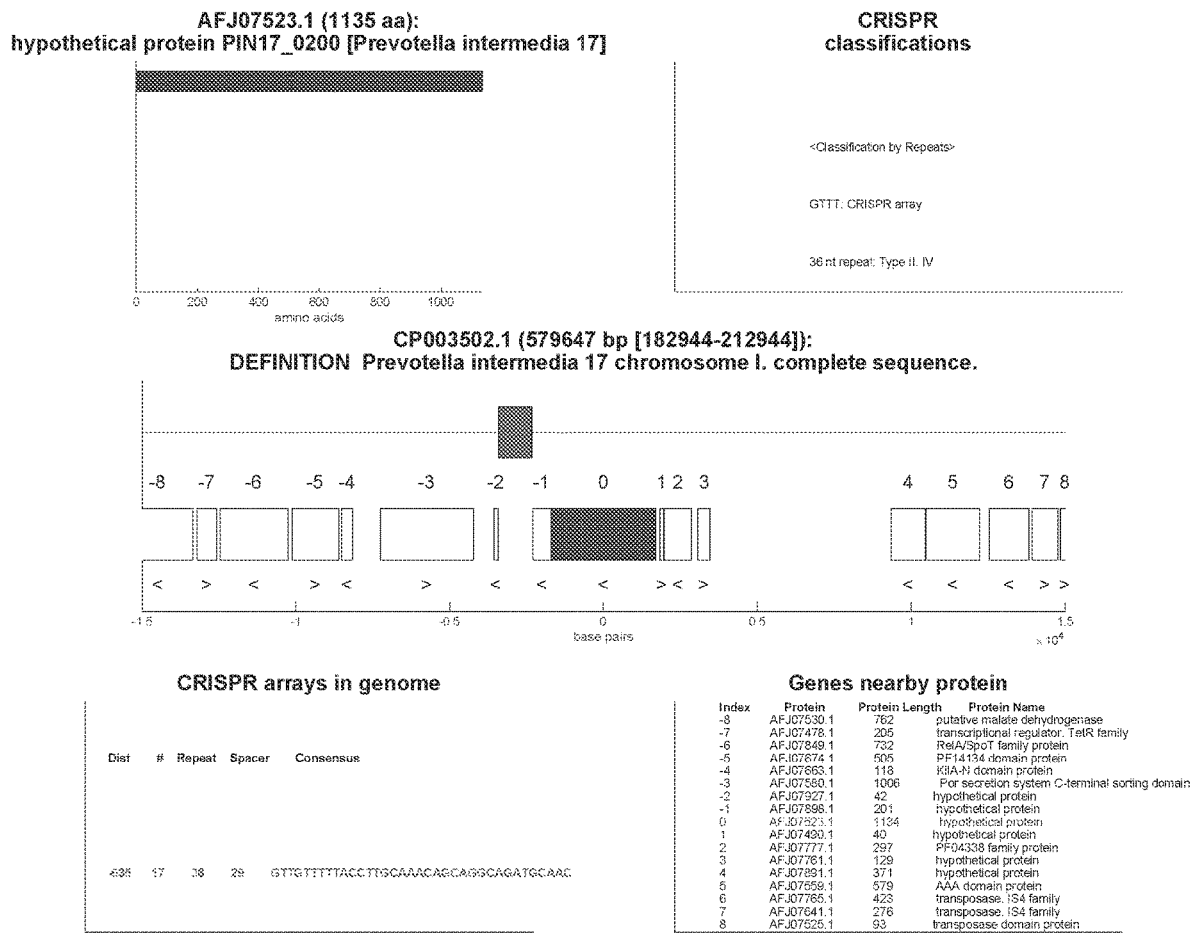
Figure 4J:
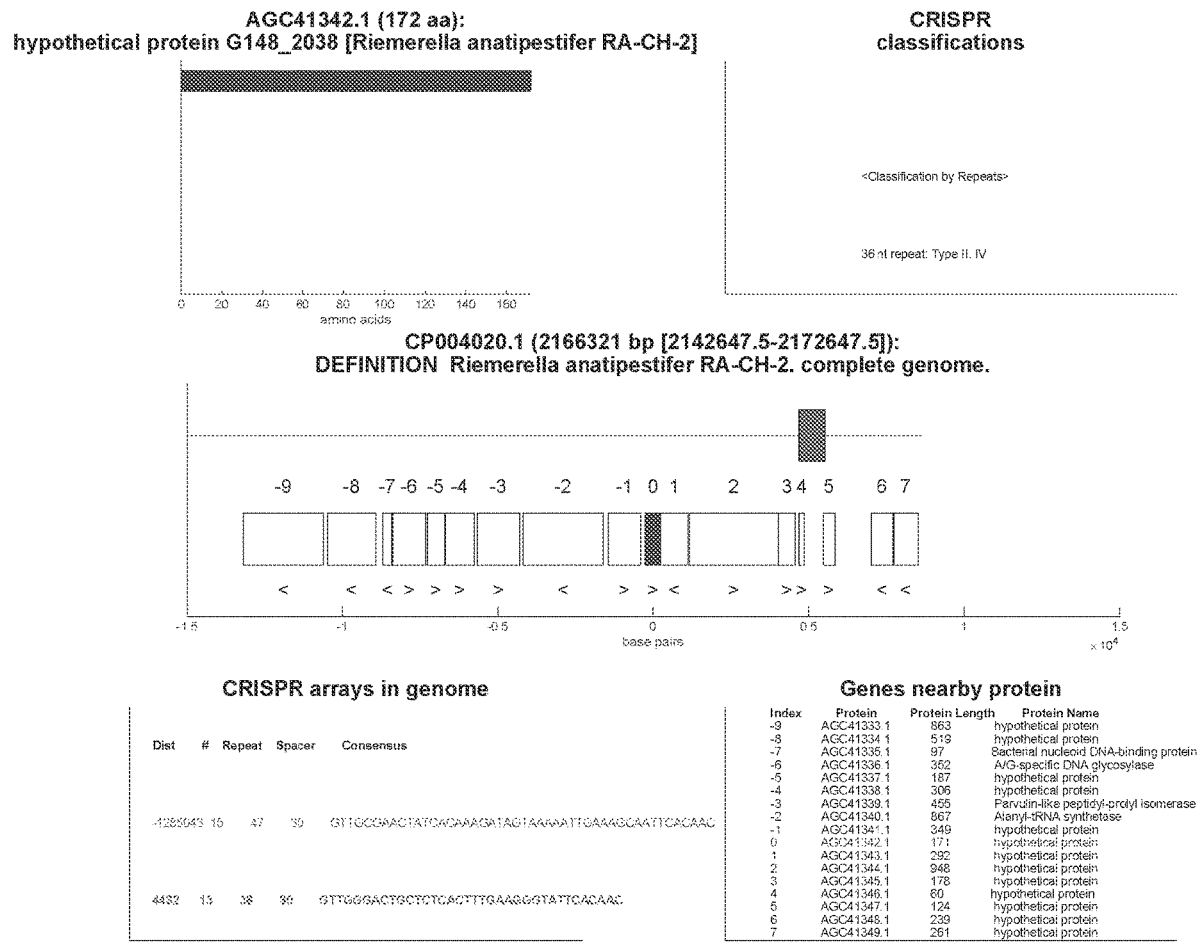
Figure 4K:
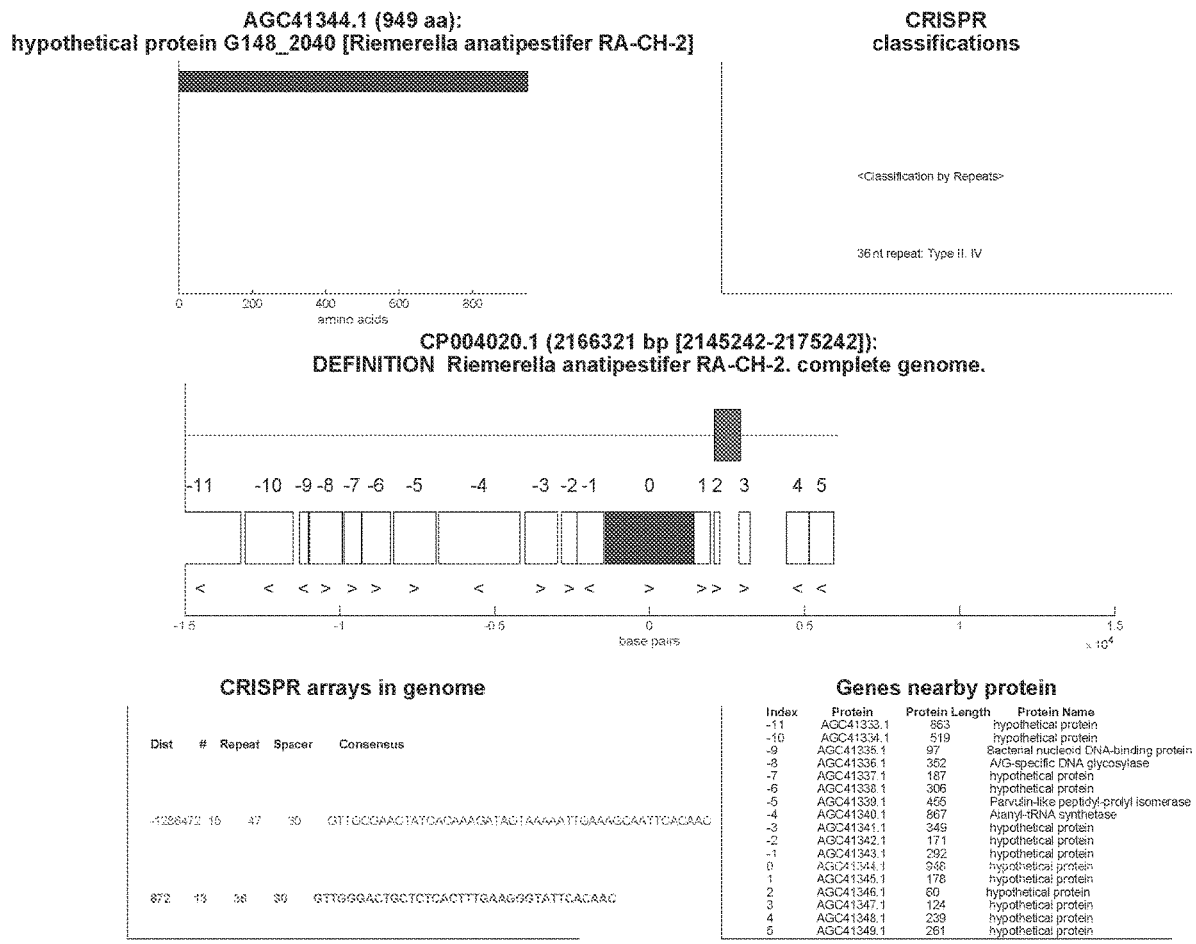
Figure 4L:
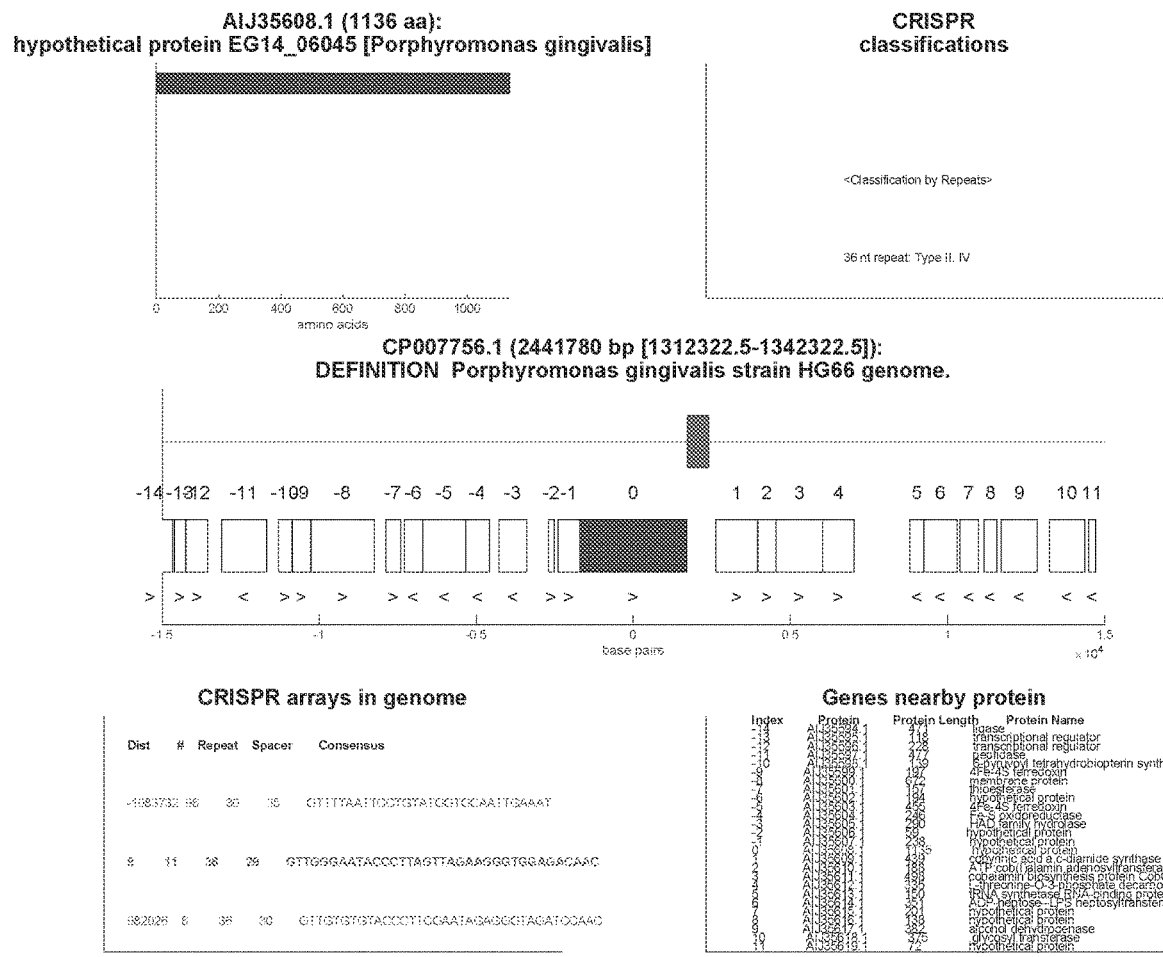
Figure 4M:
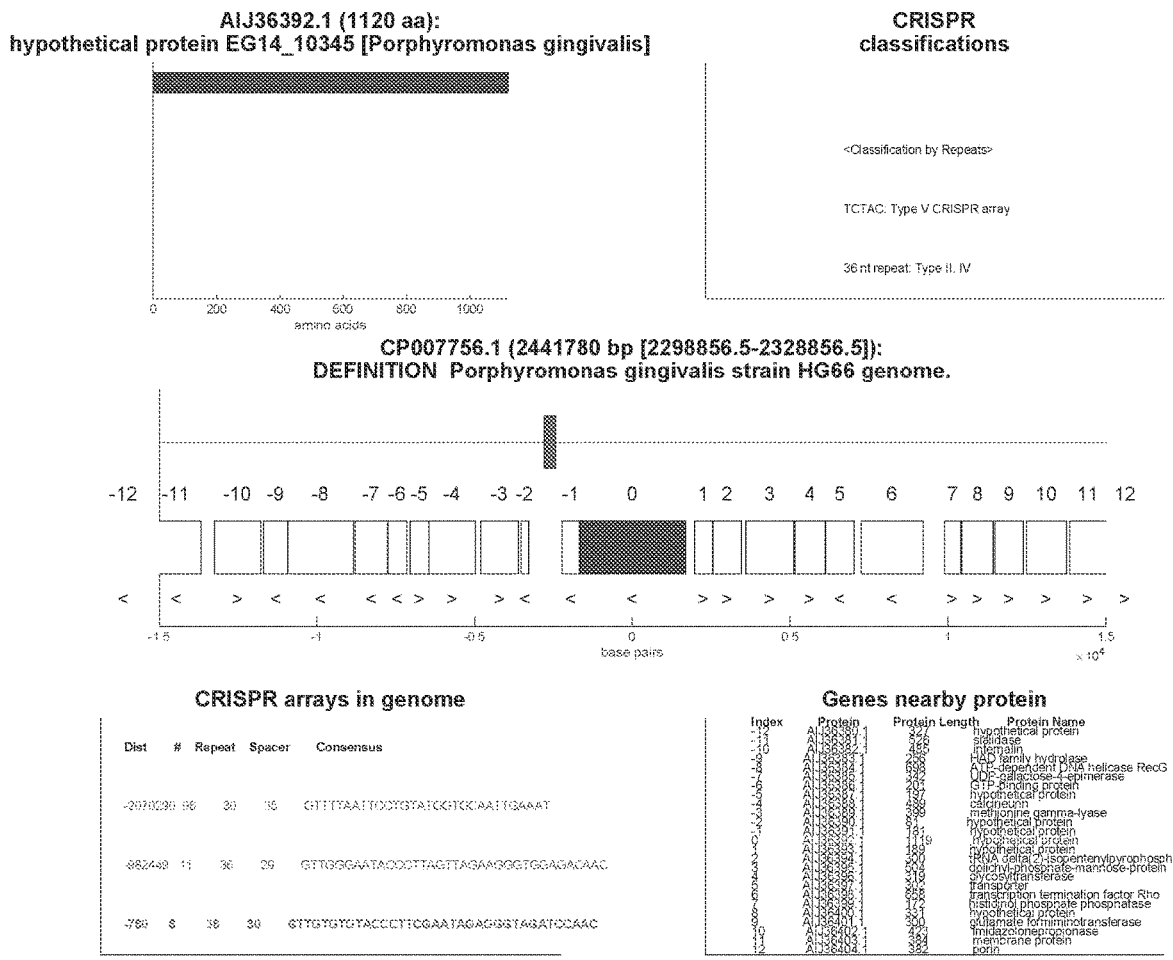
Figure 4N:
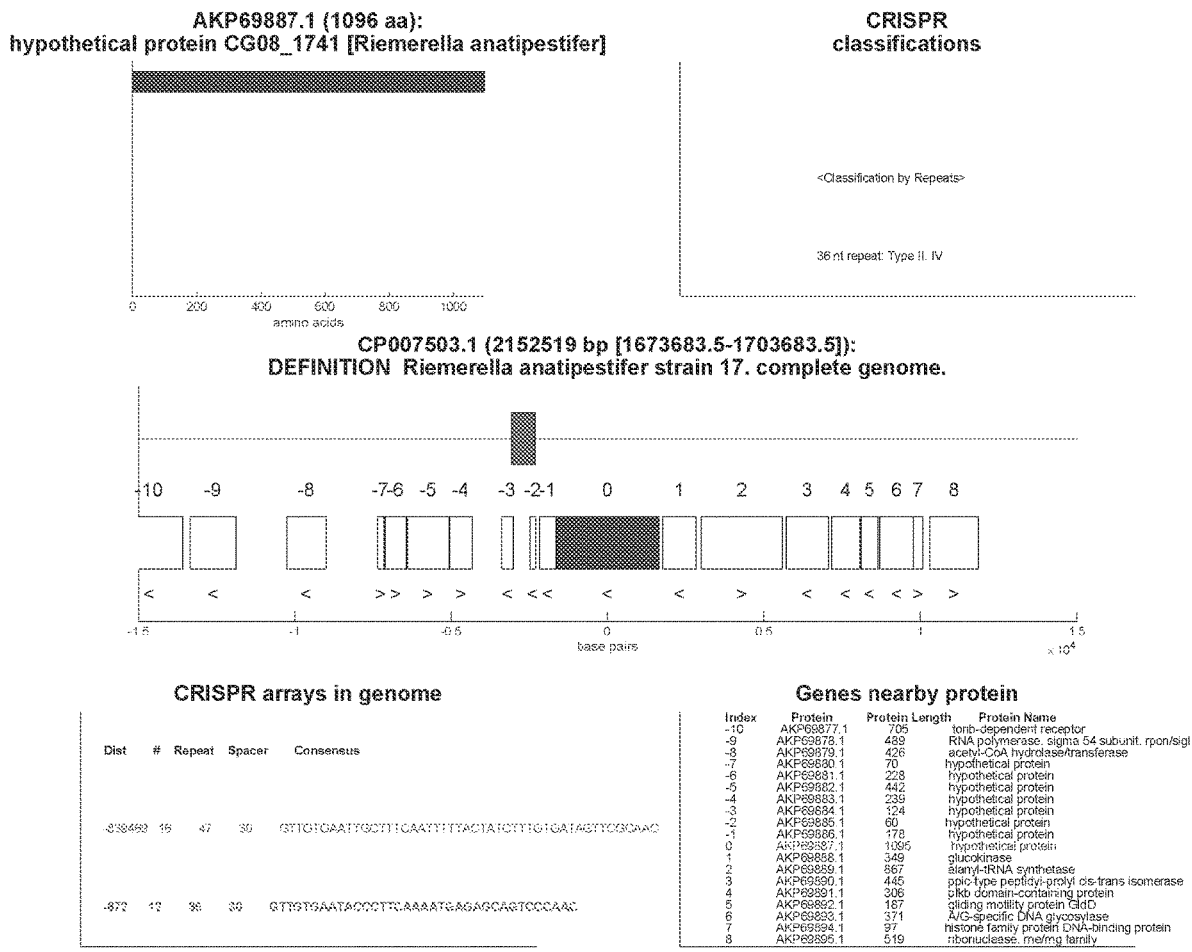

From the data obtained and annotated, genomic loci are visualized, as in FIG. 3 for the case of Cas9 of the pathogen *Finegoldia magna*. In order to select experimental candidates, it is relevant to consider proteins with low HHpred homology matches, minimal existing CRISPR classifications, short distance of protein from CRISPR array in genomic locus, identical orientation of protein with respect to adjacent proteins, consistent nature of CRISPR arrays in the genome, and presence of few annotated CRISPR proteins nearby. Based on the number of protein candidates within a family determined by NCBI BLAST homology, one can assess whether said family is evolutionarily conserved, and thus whether it is likely to be biologically functional. Applicants looked for conserved domains, even if previously unannotated, among proteins within a family.

Experimental Procedure: Discovering New Class 2 Loci-Group 29

When subjected to NCBI BLAST homology searches, the 1,531 candidates grew to roughly 7,200 proteins. These proteins and their respective loci were grouped into 266 folders according to a nearest-neighbor E-value cutoff of 1e-7. Many of these groups were false positives, for example transposons and methylases, the majority in the group of which was not correlated with any CRISPR arrays. Several of the groups were in fact Class 1 CRISPR loci that had passed the large single effector-filter. Quite a few groups were bona fide Class 2 CRISPR loci-including Cas9, Cpf1, and C2c2-some in the group of which had no Cas1 or Cas2 proximate. One group in particular, sorted into folder 29, possessed a diverse set of novel proteins all lacking Cas1 or Cas2 proximate. Referred to in this specification as either "Group 29" or "Grp29", this system embodying two loci will now be described in bio computational detail.

Figure 78:
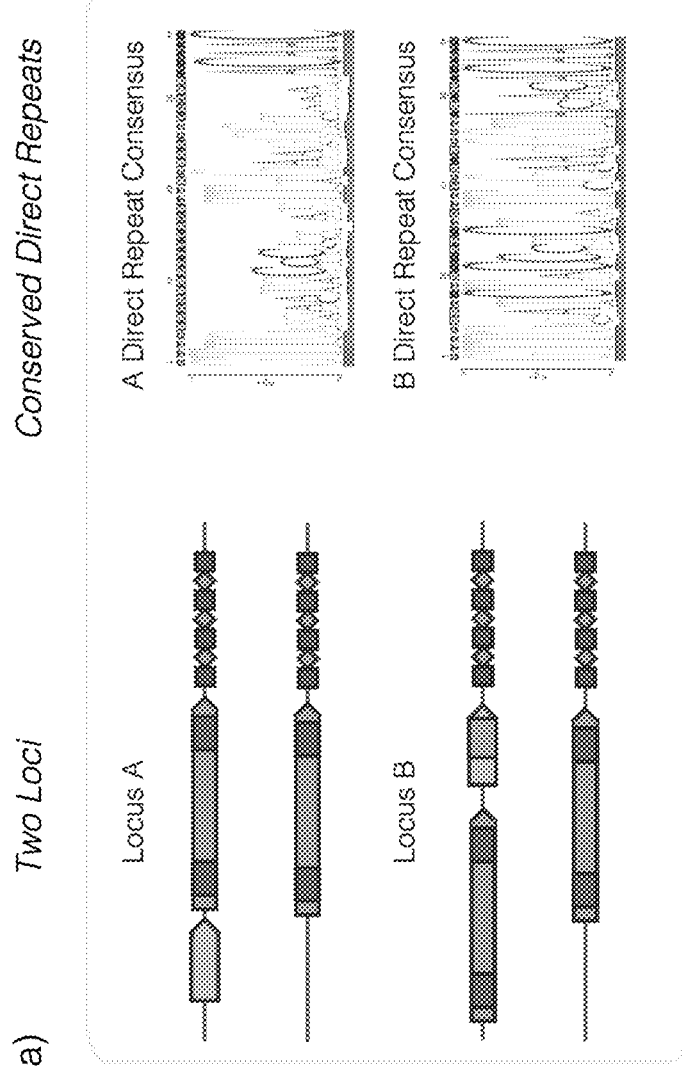
Figure 79:
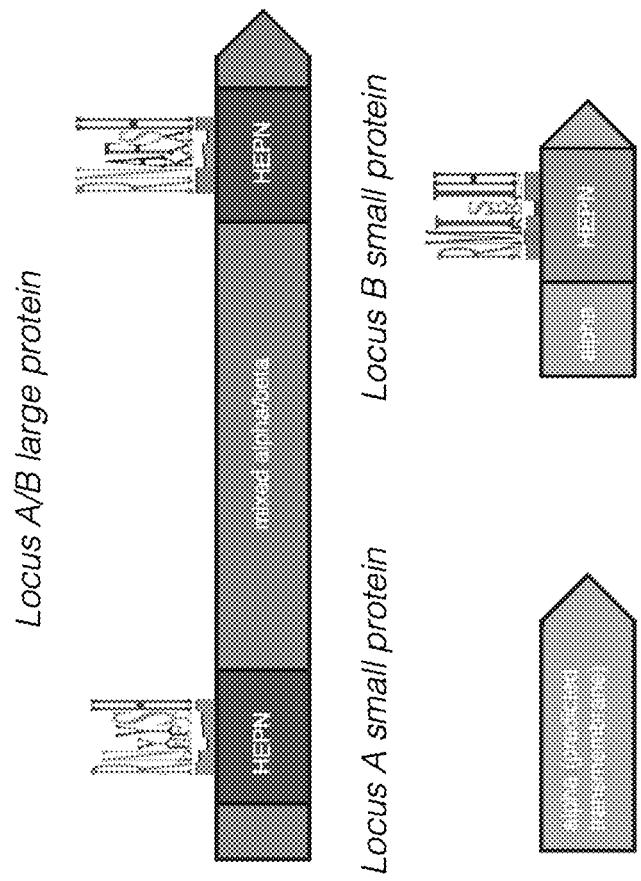

The Group 29 system consists of a large single effector (~1100 amino acids in length) and one-or none-of two small putative accessory proteins (~200 amino acids in length) nearby a CRISPR array. Based on the nearby small protein, the system is bifurcated into two Loci A and B, depicted in FIGS. 78 and 79. No additional proteins out to 25 kilobase pairs upstream or downstream from the array are conserved across species with each locus. With minor exceptions, the CRISPR array consists of direct repeat sequences 36 nucleotides in length and spacer sequences 30 nucleotides in length. The direct repeat is generally well conserved, especially at the ends, with a GTTG/GUUG at the 5' end reverse complementary to a CAAC at the 3' end. This conservation suggests strong base pairing for an RNA loop structure that potentially interacts with the protein(s) in the locus. A motif search complementary to the direct repeats revealed no candidate tracrRNAs nearby the arrays, possibly indicative of a single crRNA like that found in the Cpf1 locus.

A phage genome search of Grp29 spacer sequences using CRISPR Target revealed no sequence matches above 90% (Biswas et al., 2013). The result is unsurprising, given how few phage genomes have been sequenced, in addition to the relatively high mutation rates phages endure to evade bacterial adaptive immunity. From the unreliability of matches, a target-flanking PAM sequence could not be predicted.

Each of the proteins possesses interesting structure. The large protein contains many conserved residues forming putative domains interspersed within a mixed alpha helix/beta sheet structure. Two HEPN domains (each of the amino acid motif RXXXXH) are located near the N and C termini of the protein, respectively. Given the predicted RNAse activity of HEPN domains, two of which are also present in the interior of the C2c2 protein, it is predicted that Grp29 may be an RNA-targeting effector, though rigorous experimental follow-up outside the scope of this thesis is required to validate this assumption (Anantharaman et. al, 2013; Shmakov et al., 2015).

Figure 80:
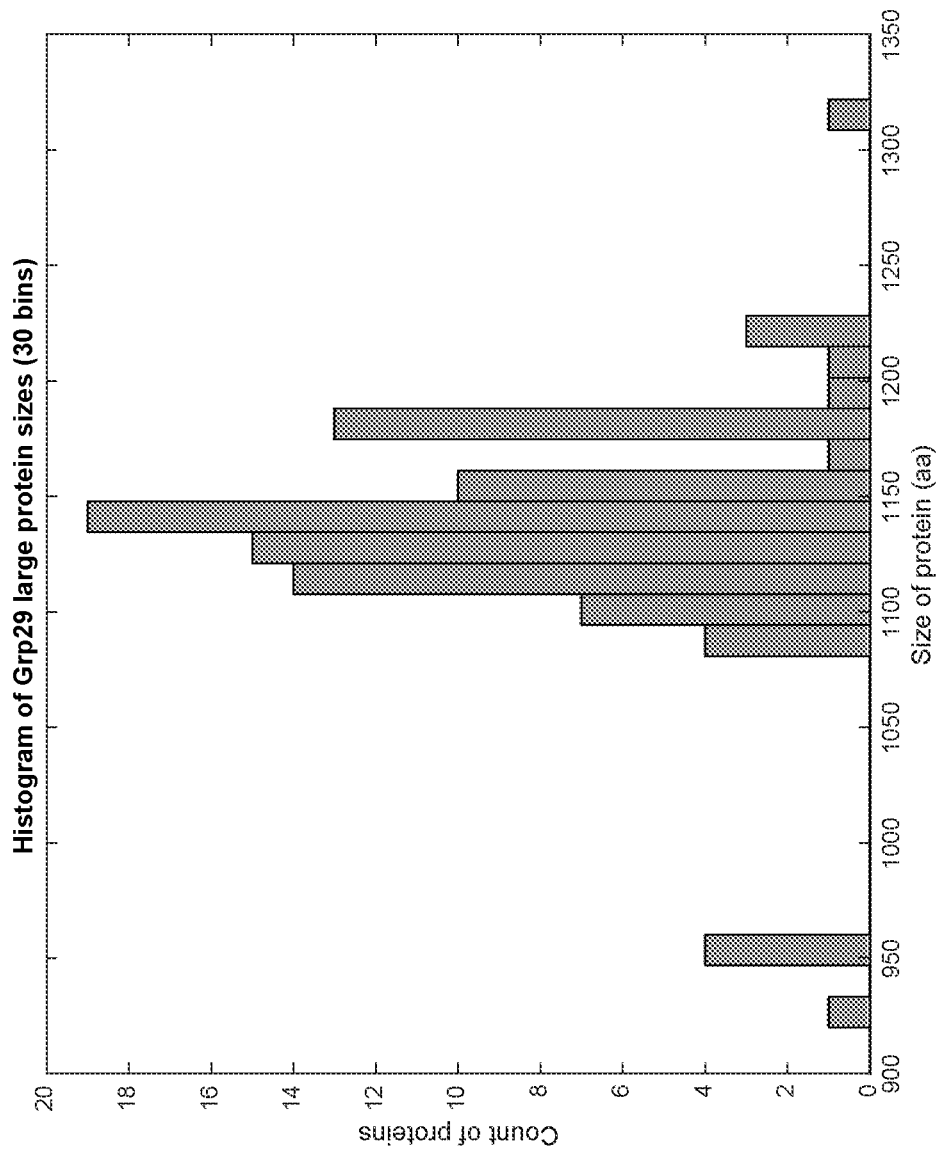

The small proteins fall into two distinct categories. In Locus A the small protein is predicted to contain four putative transmembrane domains throughout, whereas in Locus B it is predicted to contain a single putative transmembrane domain near the N-terminus and a HEPN domain (amino acid motif RXXXXH) near the C-terminus. Each of the transmembrane domains was recognized with high probability by TMHMM, a membrane protein topology prediction model implementing a hidden Markov model (Krogh et al., 2001). Transmembrane domains typically contain hydrophobic residues, and are therefore likely to localize to the cellular membrane. (It is worth noting that often signaling peptides at the N-terminus of a protein may be mistaken for a transmembrane domain, as may be the case with the small protein of Locus B.). Characterizing Group 29 loci A total of 111 large proteins from Group 29 loci were found through a series of exhaustive NCBI BLAST homology searches. Multiple sequence alignment of the 111 revealed that only 94 were complete annotated proteins, the remainder typically falling at the end of a sequencing fragment. The size distribution of the 94 is shown in FIG. 80. Most large proteins fall tightly in the size range of 1100-1150 amino acids, suggestive of low divergence either due to relatively short genetic time span or strong selective pressure to maintain similar form.

Figure 81:
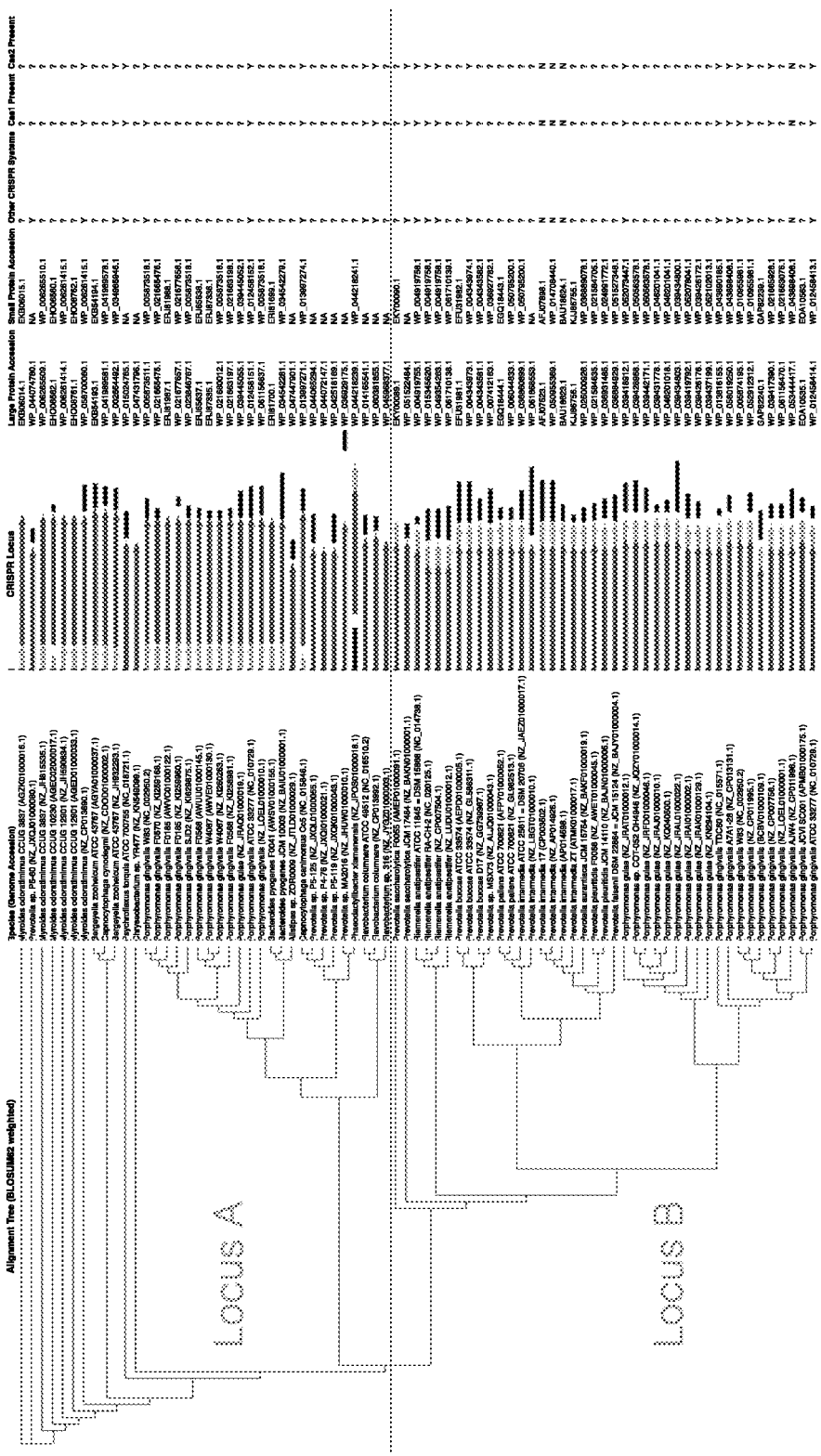

Of these 94 large proteins, only 77 were found to be non-redundant protein entries on NCBI. The BLOSUM62 algorithm was used to align large proteins and generate a phylogenic tree, depicted along with species and locus information in FIG. 81.

The species represented are found in Bacteroidetes, a broad phylum of Gram-negative, rod-shaped bacteria. Notably, the gut microbes *Porphyromonas gingivalis* and *Porphyromonas gulae* possess both loci. There are a few exceptions to the rules outlined in the previous section: i) Locus A has quite a few more species without a small protein than does Locus B, ii) CRISPR arrays as recognized by PILERCR are not present in all loci, and iii) the recently discovered chemoheterotrophic *Phaeodactylibacter xiamenensis* has both an outlier locus orientation and direct repeat sequence:

(SEQ ID NO: 30)
5'-GTCCTAGTCACTCCTCAAACCGGGAGCCTATCGGAC-3'.

Figure 82:
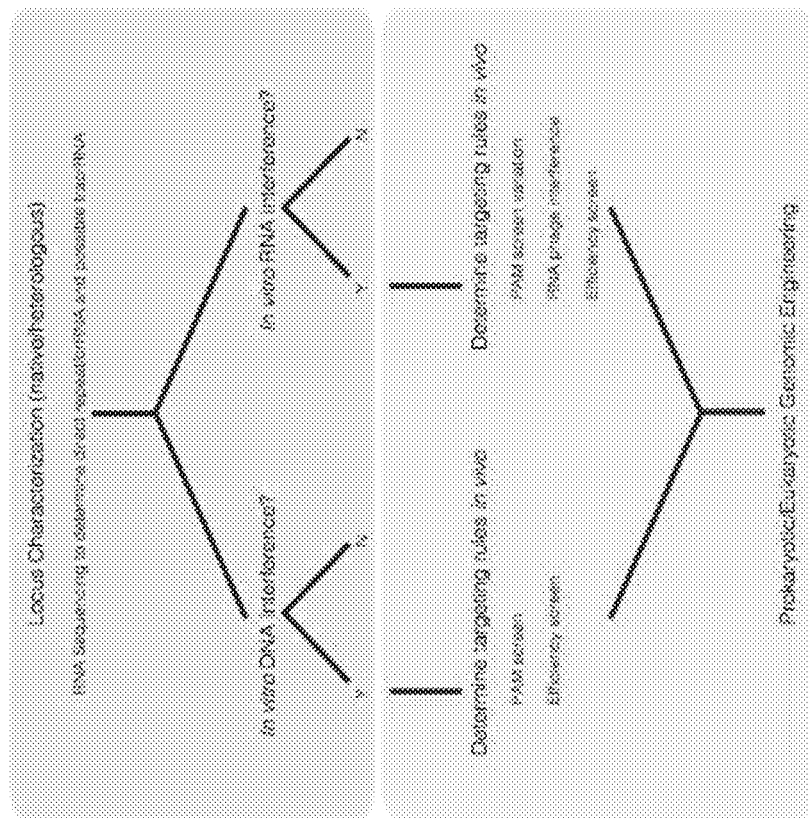

Most bacterial strains do not have fully annotated genomes, and so it cannot be concluded whether there exist other CRISPR systems in their genomes. (This is indicated by a question mark in the last three columns of the FIG. 81.) A few strains of species with the Group 29 locus, *Prevotella intermedia* and *Porphyromonas gingivalis*, possess no Cas1 or Cas2 in their entire genomes. Given that CRISPR systems are suspected to propagate through horizontal gene transfer and not evolution, and that a CRISPR system does not explicitly require adaptive Cas1/Cas2 nearby (it can recruit them in trans, possibly the case for all Group 29 loci) or even in the entire genome (CRISPR systems can continue to function without adaptation), the results do not argue strongly in favor of self-adaptation in the Group 29 system. Translating Computational Work into Experimental Workflow to Yield Novel Effectors FIG. 82 depicts a minimalist experimental workflow from Group 29 locus discovery to potential genomic engineering applications. The workflow begins with locus characterization. From biocomputational work, the bacterial strain containing the locus of interest is known. One can therefore order the strain and its genomic DNA, and perform RNA sequencing, either on the native strain or on the locus heterologously transplanted into a well-established model organism such as *Escherichia coli*. Heterologous expression entails the integration of the locus (protein and CRISPR array) into a plasmid transformed under drug selection into the model organism. In the case where native regulatory elements of the locus are insufficient to express the protein and/or CRISPR array, synthetic gene promoter(s) must be inserted to drive expression. From the RNA sequencing data, one can gather whether the protein sufficiently processes the CRISPR array into crRNA for RNA-programmable nucleic acid targeting. RNA sequencing can be performed in a number of ways, all of which convert bacterially harvested RNA into DNA libraries to be sequenced on Next Generation Sequencing machines (Adiconis et al., 2013; Mardis, 2013).

If the protein does process its CRISPR array, RNA sequencing will indicate the nature of the mature crRNA, both in length and orientation. This information can be used to design a two-component system consisting of the protein and mature crRNA to perform in vitro interference experiments. In these experiments, protein purified from bacteria and crRNA synthesized by in vitro transcription are incubated with a target nucleic acid (DNA or RNA). The product of the incubation is run on an agarose gel, and derivation from the control condition (typically without protein and/or crRNA) indicates cleavage of the target.

It is expected that the HEPN domains that Grp29 may interfere with RNA, therefore both DNA and RNA targets must be tested. If either shows interference, the next stage is to determine the targeting rules in vivo. The PAM screen is designed to reveal any cleavage-mediating sequence motifs flanking the target sequence reverse complementary to the spacer sequence, and may be adapted to discover RNA targeting motifs (Zetsche et al., 2015). Efficiency screens may also be performed, especially if the targeting rules are more complex than a PAM (Doench et. al, 2014). For RNA targeting in particular, RNA phage interference experiments ought to be conducted to show that RNA interference alone, and not transcriptionally dependent RNA interference, is responsible (Tamulaitis et al., 2014).

For potential endonucleases, Applicants ordered the bacterial species with the proteins of interest and cloned their genomic loci into plasmids for transformation into competent *E. coli*. Applicants then performed RNA sequencing on the bacteria and the transformed *E. coli* to determine transcribed RNAs in the vicinity of the CRISPR array. Following this initial characterization, Applicants screened for PAMs by cloning a library of randomly synthesized nucleotides flanking spacer sequences and co-transforming with the plasmids containing genomic loci. Through Next Generation Sequencing and observing depletion of certain randomized nucleotides, Applicants predicted PAM sequences. After PAM validation in bacterial colonies, Applicants synthesized predicted crRNAs (and tracrRNAs and sgRNAs if possible), purified protein of interest from cell lysate, and performed in vitro cleavage assays, observing cutting through the Surveyor method. Applicants followed up with experiments in mammalian cells to assess for eukaryotic genomic engineering potential.

Applicants identified Group 29 proteins to be a set of RNA-programmable, RNA-interfering nucleases possibly involved in bacterial adaptive immunity against RNA phages. This is based on the predicted presence of known RNA-catalytic HEPN domains near their N and C termini, and RNA-Seq data indicating processing of an adjacent CRISPR array into putative crRNAs. The Group 30 proteins identified are a couple proteins with little local alignment to Group 29 but which congregate with one of the accessory small proteins from Group 29.

Figure 46B:
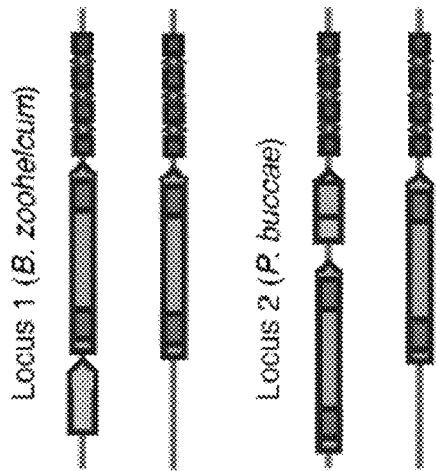
FIGS. 46A-46C show the discovery of a novel Class 2 CRISPR-Cas system, type VI-B.
Figure 68:
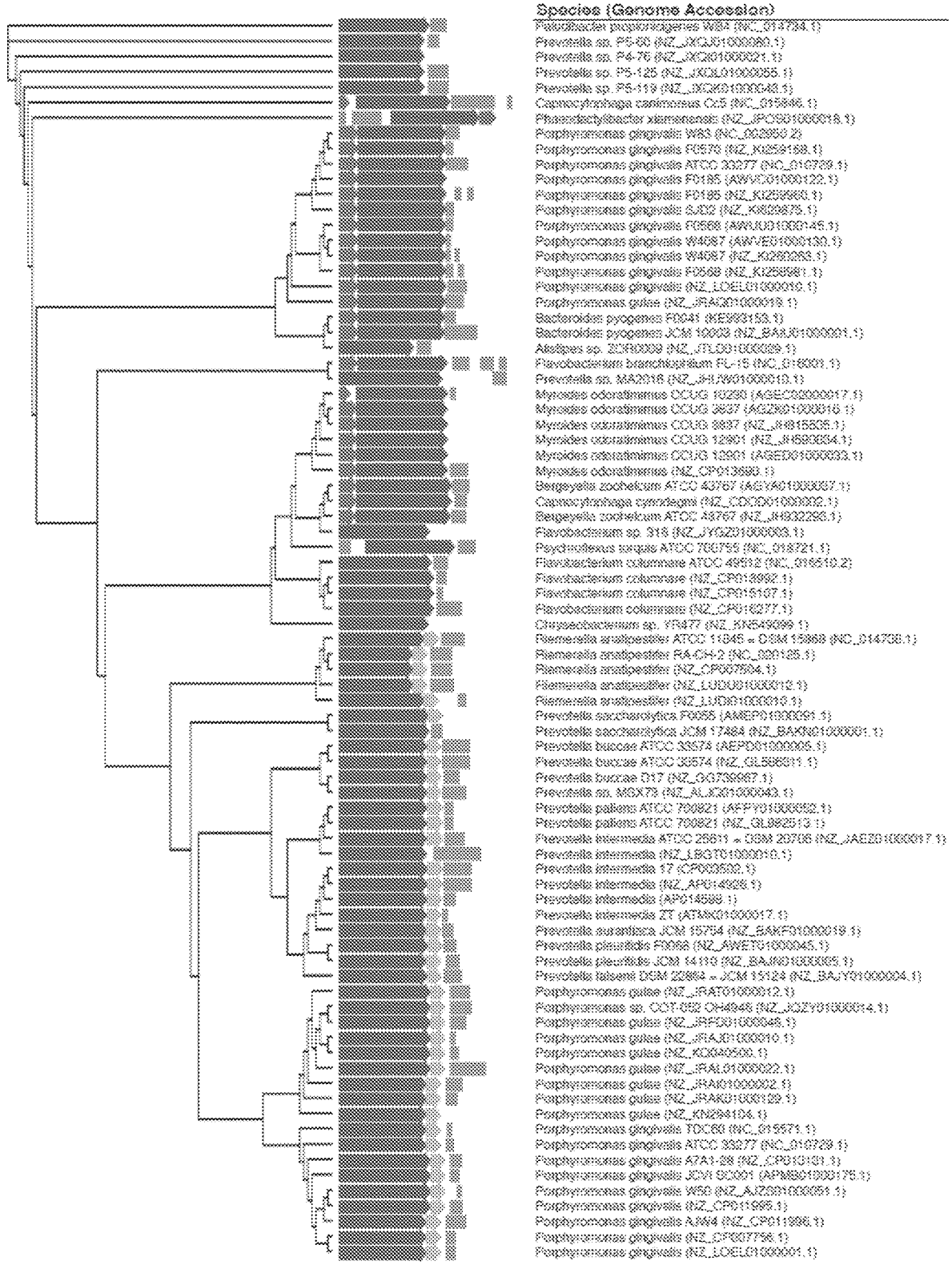

From Group 29 and 30 proteins, Applicants identified two novel, genetically diverse putative Class 2 CRISPR-Cas systems (105 total genomic loci; 81 loci with a non-redundant single effector) represented in Gram-positive bacteria. All these loci encode a large (~1100aa) candidate effector protein and, in about 80% of the loci, an additional small (~200aa) protein (FIG. 46*b*, FIG. 68). The putative effector proteins contain two predicted HEPN domains at their N- and C-termini (Anantharaman et al., 2013), similar to the domain architecture of the large effector in the Class 2 type VI-A system (Cas13a). Beyond the catalytic signatures of the HEPN domains, however, there was no significant sequence similarity between the new predicted effector and Cas13a. Accordingly, we classified these systems as subtype VI-B and denoted its putative effector protein Cas13b.

Figure 46C:
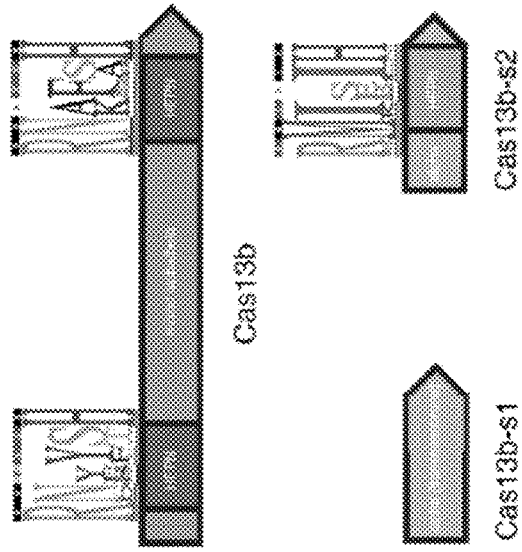
Figure 46A:
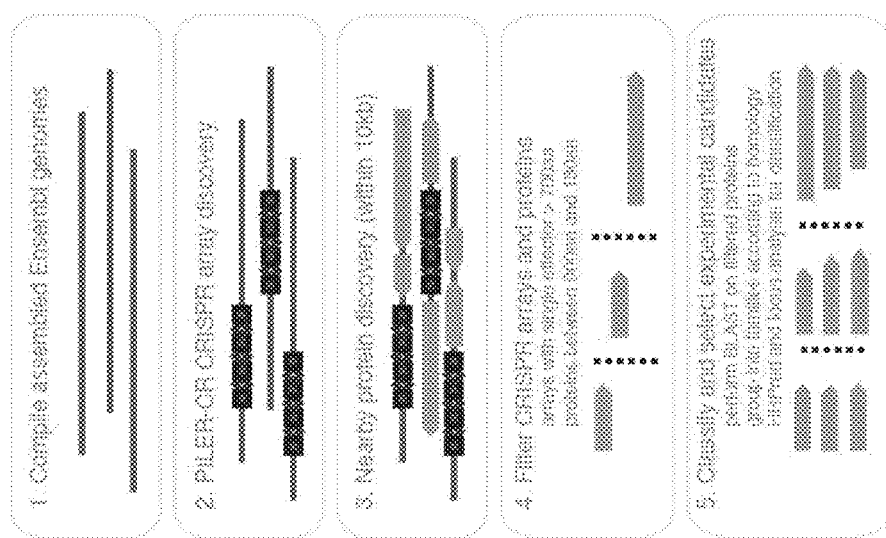

The presence of one or the other putative accessory protein correlates with the two distinct branches in the phylogenetic tree of Cas13b, indicative of the existence of two variant systems, which we denoted VI-B1 (accessory protein Csx27) and VI-B2 (accessory protein Csx28). The type VI-B2 systems we identified almost invariantly contain csx28, whereas csx27 is less consistently present in VI-B1 loci. The Csx27 and Csx28 protein sequences show no significant similarity to any previously identified CRISPR-associated proteins. Both Csx27 and Csx28 were predicted to contain one or more transmembrane segments (FIG. 71A). However, RFP-tagged Csx27 of *Bergeyella zoohelcum* and Csx28 *Prevotella buccae* at either the N- or C-terminus did not noticeably localize to the membrane (FIG. 71B), suggesting that both are soluble proteins despite the presence of hydrophobic a-helicase domains. In addition, analysis of the multiple alignment of Csx28 proteins indicated the presence of a highly diverged HEPN domain (FIG. 46C).

Figure 69A:
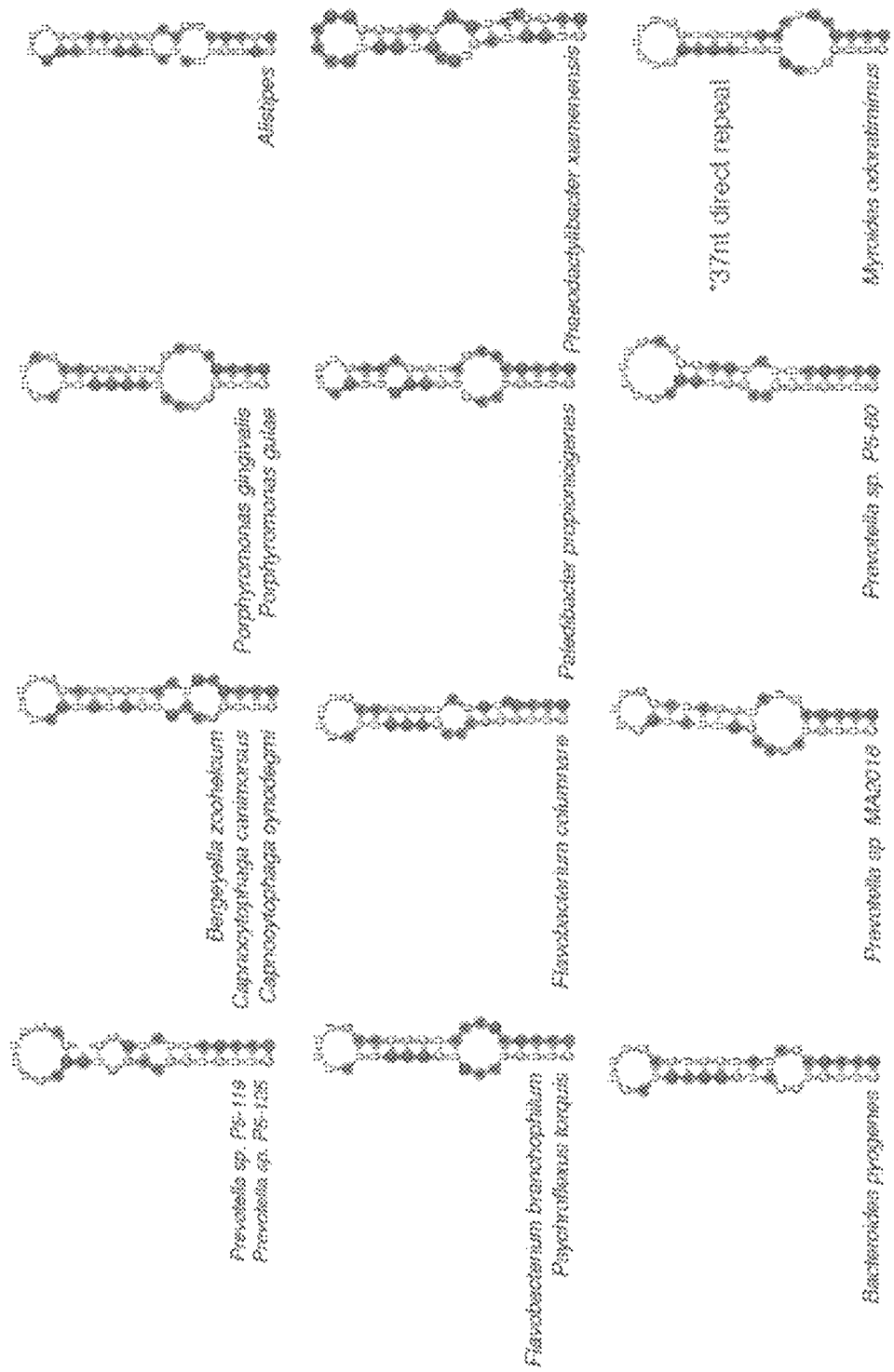
Figure 69B:
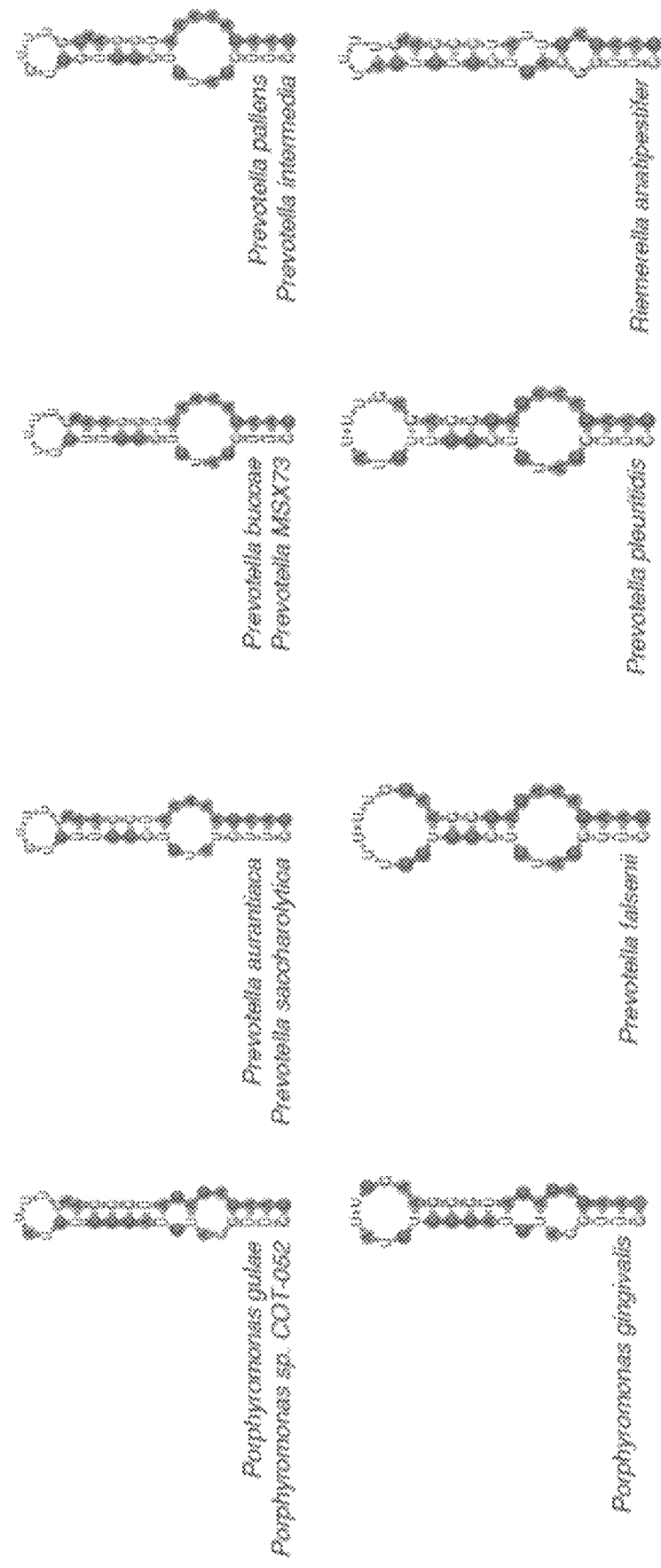
Figure 70A:
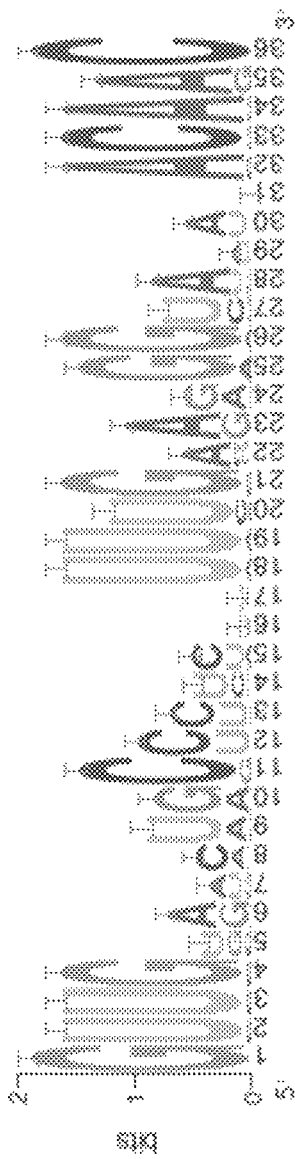
Figure 70B:
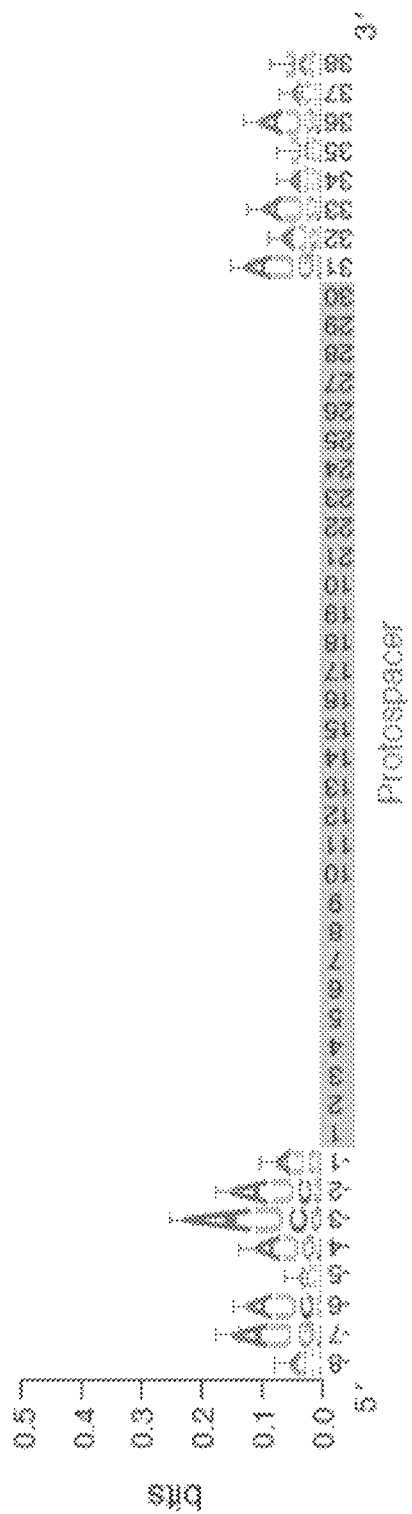

Unlike their divergent putative accessory proteins, both type VI-B systems show distinct, conserved features in the CRISPR arrays. The direct repeats in the CRISPR arrays are conserved in size, sequence, and structure (FIGS. 69 & 70A), with a length of 36nt, a poly-U stretch in the open loop region, and complementary sequences 5'-GUUG and CAAC-3' at the ends of the repeat predicted to yield a defined secondary structure mediated by intramolecular base-pairing. Although a CRISPRTarget probe of protospacers revealed no consensus flanking region sequence (FIG. 70B) (Biswas et al., 2013), a well-conserved protospacer length of 30nt combined with the well-conserved direct repeat sequence and length suggests the possibility of similar nucleic acid targeting rules among different VI-B loci.

Figure 47:
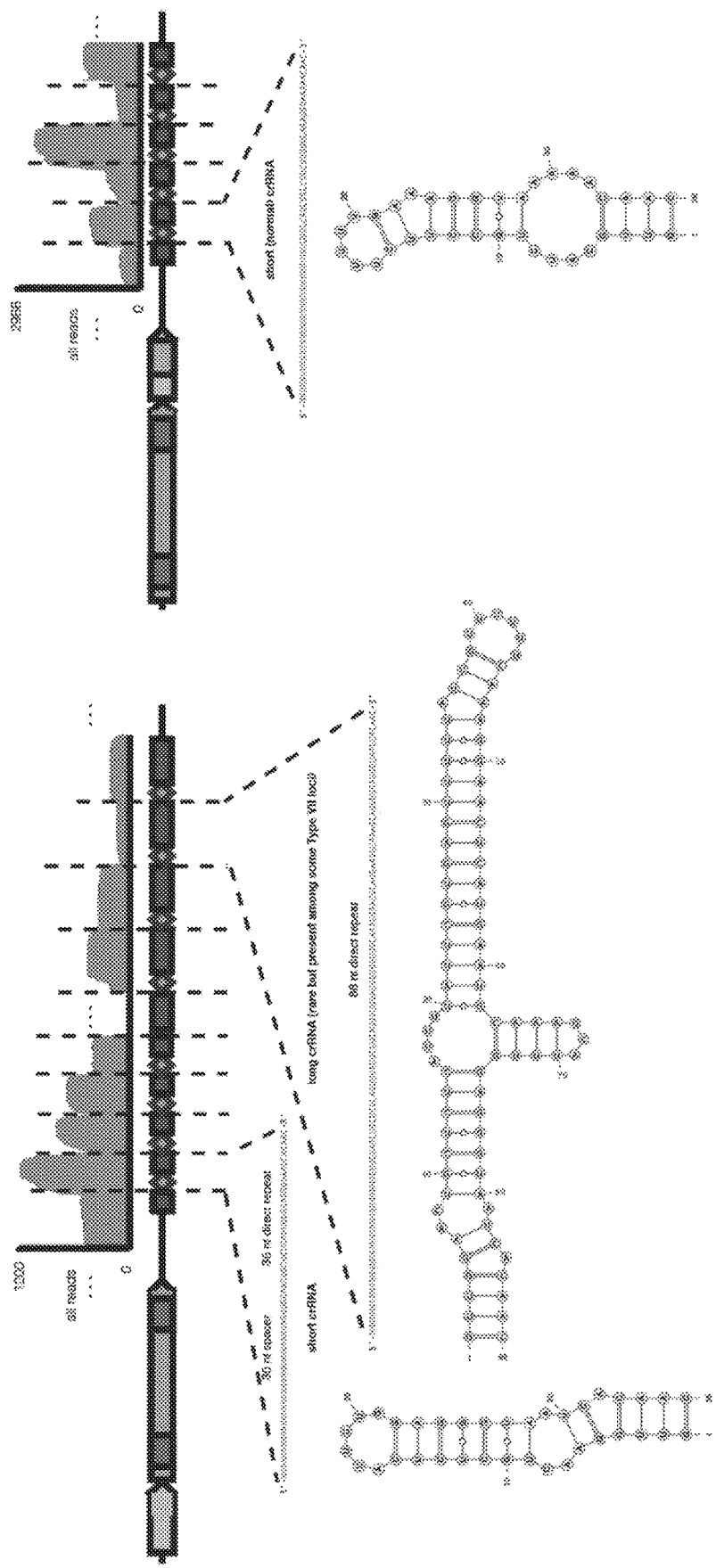
FIG. 47 shows the RNA-sequencing of VI-B CRISPR locus. Left Panel: RNA-Sequencing of native VI-B1 locus from *Bergeyella zoohelcum* ATCC 43767. Right Panel: RNA-Sequencing of heterologously expressed VI-B2 locus from *P. buccae* ATCC 33574 in *E. coli*. (SEQ ID Nos. 761 through 766)
Figure 48:
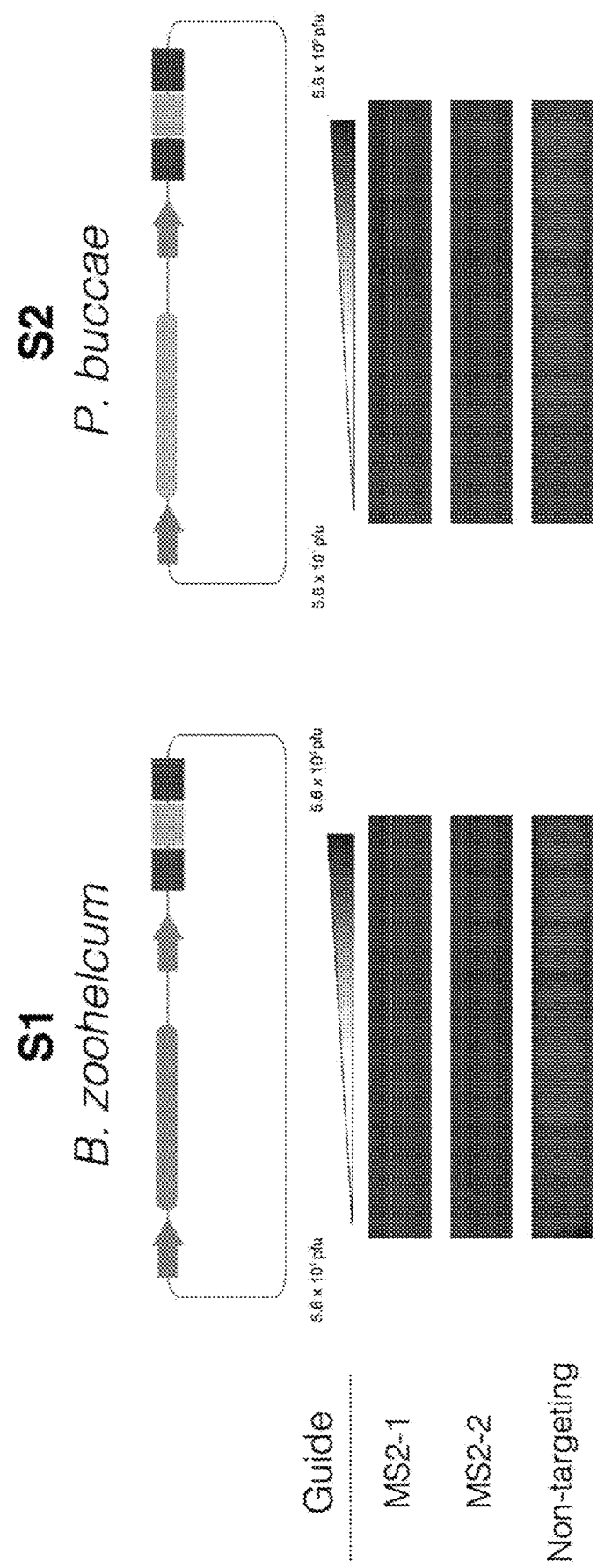
FIG. 48 depicts inhibition of MS2 plaque development by *B. zoohelcum* (S1, left panel) or *P. buccae* (S2, right panel) targeted to MS2.
Figure 49:
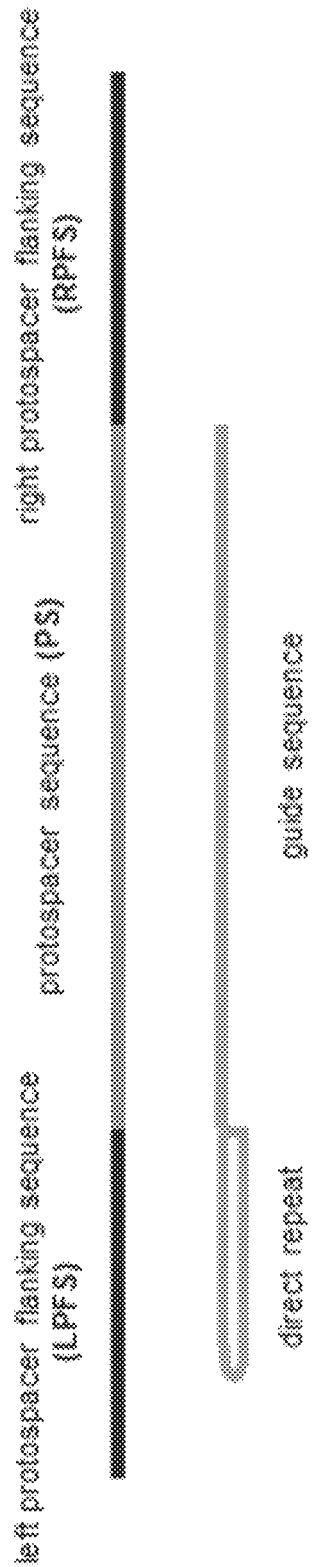
FIG. 49 depicts the structure of a Cas13b crRNA and shows the arrangement flanking a protospacer of the left protospacer flanking sequence (LPFS) and right protospacer flanking sequence (RPFS).

RNA sequencing of the CRISPR array in native *Bergeyella zoohelcum* (type VI-B1) showed processing of the pre-crRNA into a 66nt mature crRNA, with the full 30nt 5' spacer followed by the full 36nt 3' direct repeat (FIG. 47A). A longer 118nt crRNA, distal to the nominal crRNAs in the CRISPR array and consisting of 5' and 3' truncated direct repeat sequences with an intervening repeat sequence, was also processed, a phenomenon predicted to occur in other VI-B loci, suggesting it has some functional role.

Figure 64A:
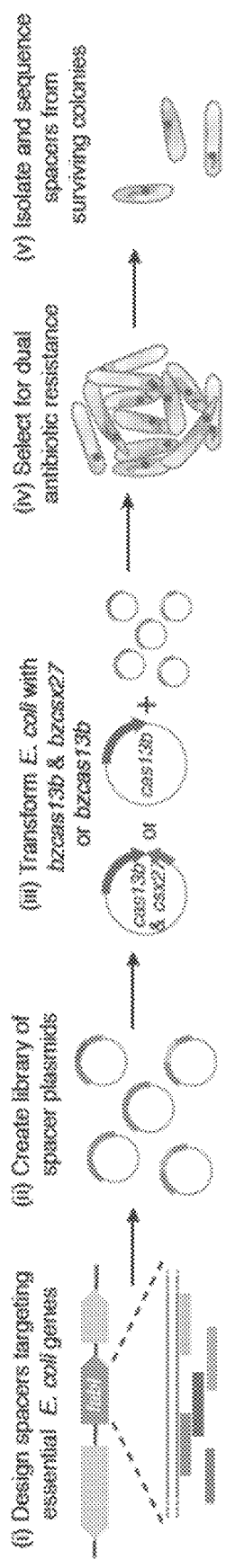
Figure 64B:
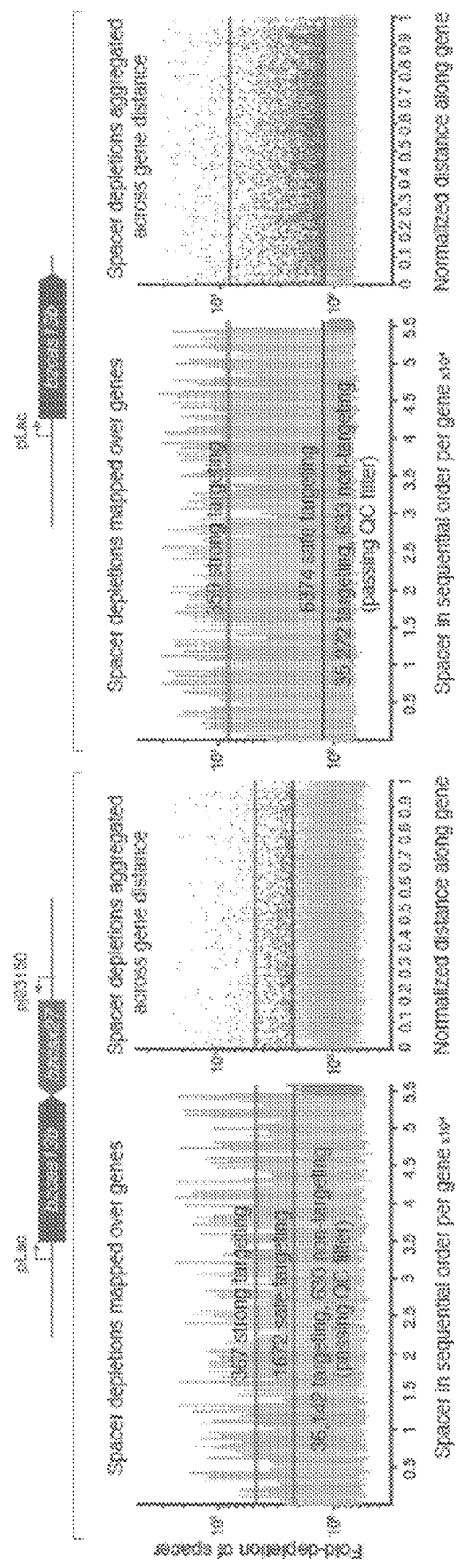

To validate the interference activity of the VI-B system and to determine the targeting rules for the VI-B1 locus from *B. zoohelcum*, Applicants developed an *E. coli* essential gene screen (FIG. 64A). For this negative selection screen, Applicants generated a library of 54,600 unique spacers tiled with single-nucleotide resolution over the coding region of 45 operon-exclusive essential genes (Gerdes et al., 2003; Baba et al., 2006), plus 60nt into the 5' and 3' UTRs, plus 1100 randomly generated non-targeting spacers. Applicants then transformed this library with plasmids carrying bzcas13b (cas13b gene from *B. zoohelcum*) and bzcsx27, just bzcas13b, or a control empty vector. After quality-control-filtering of all screen spacers, Applicants found statistically significant depletion of targeting spacers over non-targeting spacers, indicating that Cas13b alone or with Csx27 can achieve nucleic acid interference (FIG. 64B).

Figure 64C:
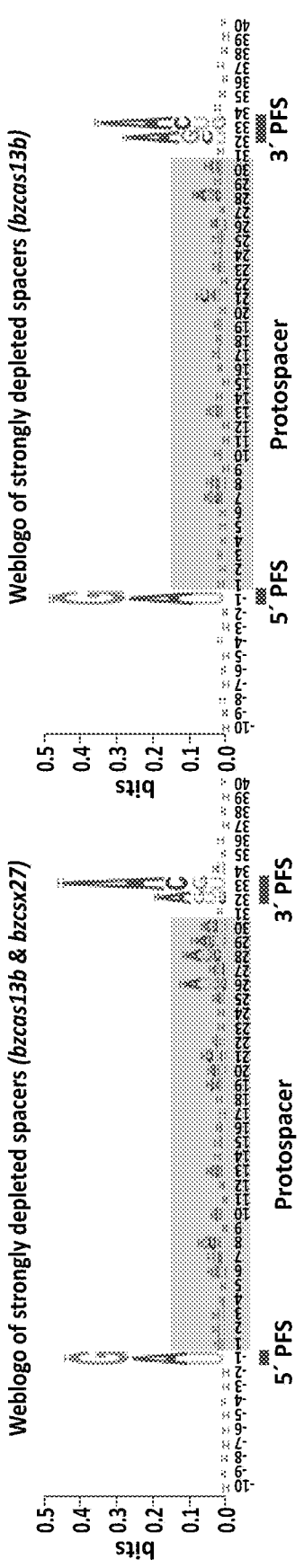
Figure 64D:
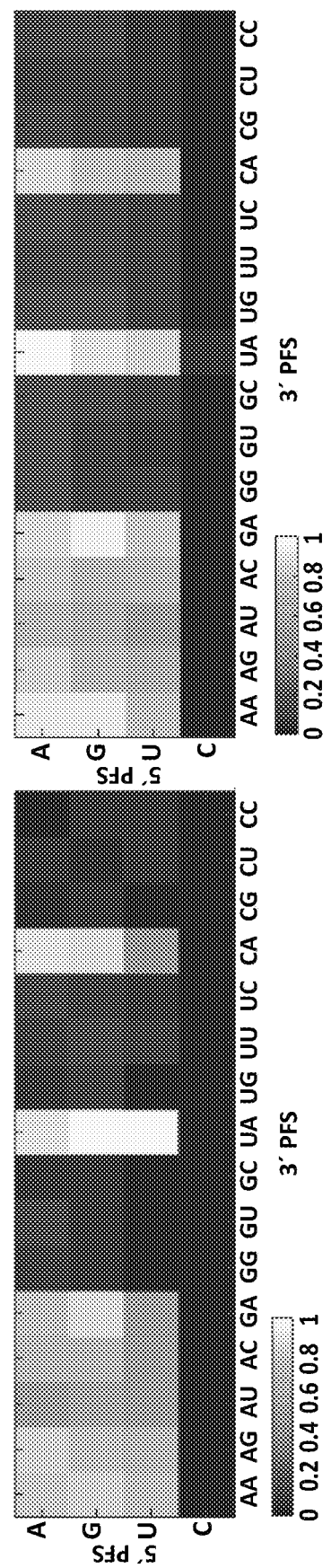

To assess Cas13b targeting rules, Applicants established two depletion levels: strongly depleted (top 1% of depleted spacers) and safely depleted (spacers depleted 56 above the mean depletion of the filtered non-targeting spacers). From spacers passing the strongly depleted cutoff, Applicants generated weblogos qualitatively identifying a double-sided protospacer flanking sequence (PFS) (FIG. 64C) (Crooks et al., 2004). Given that each base in a sequence weblogo is independent, Applicants developed a more quantitative, base-dependent PFS score defined as the ratio of the number of safely depleted spacers to the number of all spacers, normalized across all PFS scores (FIG. 64D).

Figures 72A, 72B:
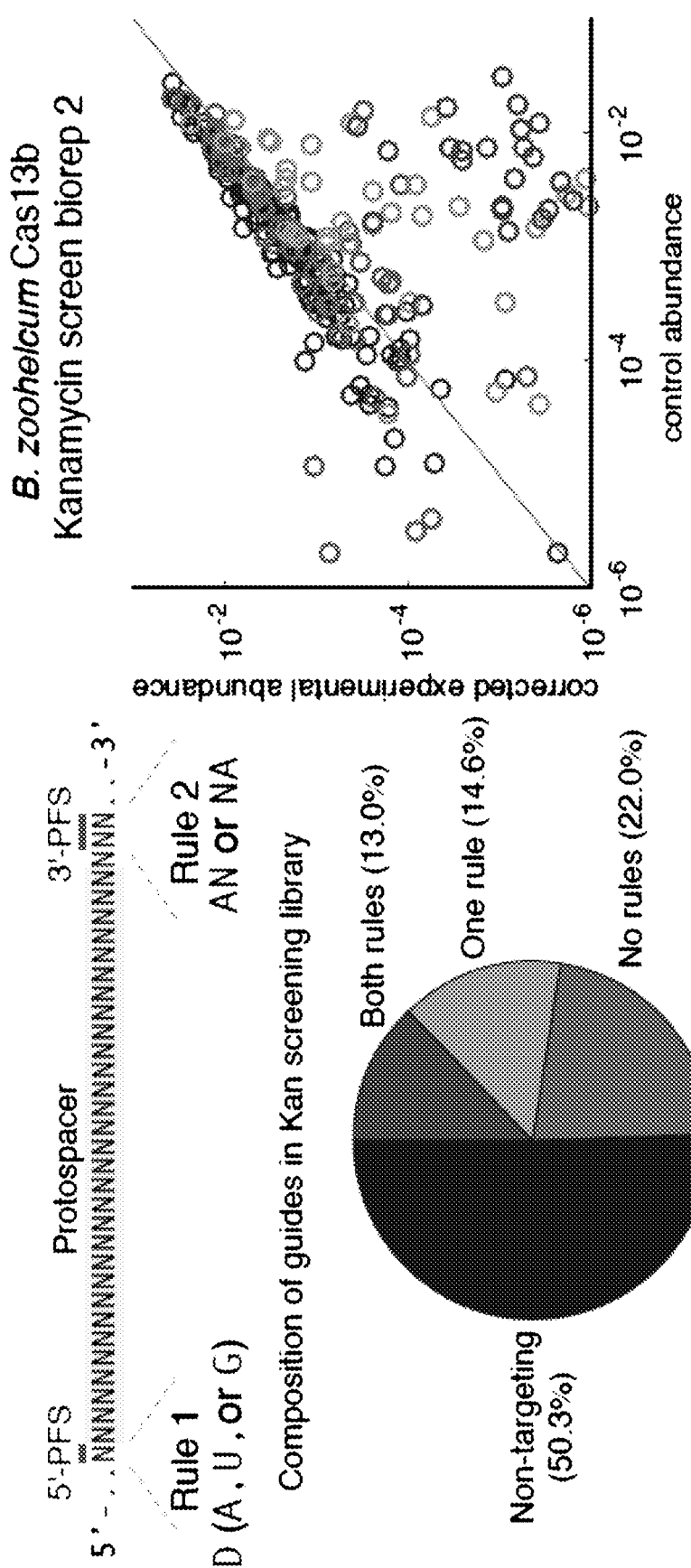

The normalized PFS scores revealed a 5' PFS of D (A, U, or G) and 3' PFS of N followed by AN or NA, consistent for both Cas13b and Csx27, as well as for Cas13b alone. To validate this sequence-targeting rule, Applicants performed an orthogonal depletion screen with Cas13b alone, targeting the Kanamycin resistance gene (FIG. 64E). Four classes of spacers were created: non-targeting, targeting with both 5' and 3' PFS rules, targeting with just the 5' or 3' PFS rule, and targeting with neither rule. Consistent with findings from the *E. coli* essential gene screen, the 5' and 3' PFS spacers resulted in the highest Kanamycin sensitivity (FIG. 64G, FIG. 72).

Figure 65A:
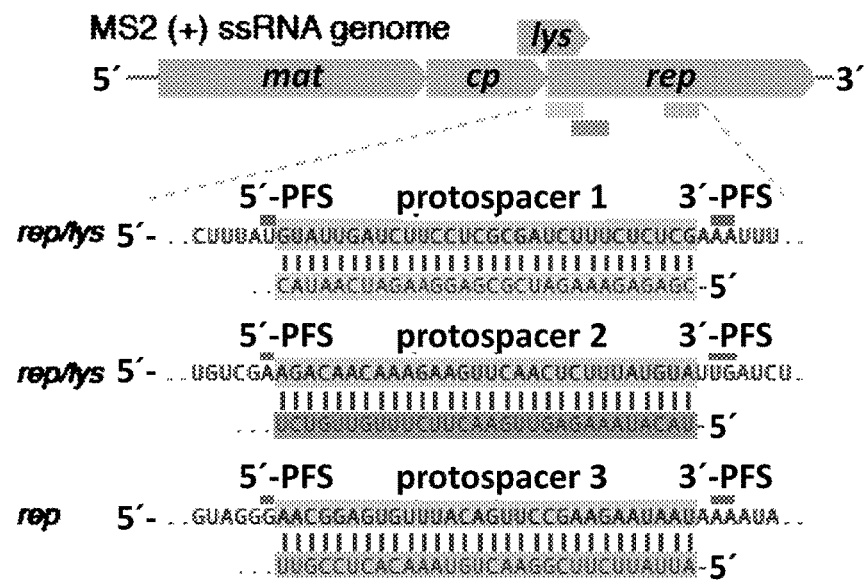
FIGS. 65A-65D: depict that Cas13b interferes with RNA, but not DNA, through HEPN domains.
Figure 65B:
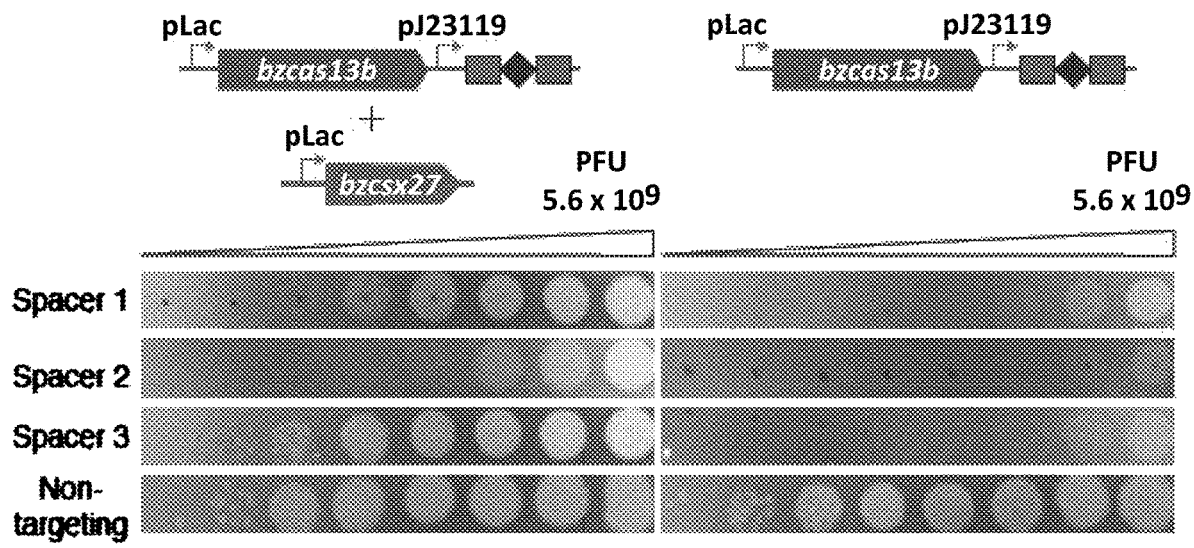
Figure 65C:
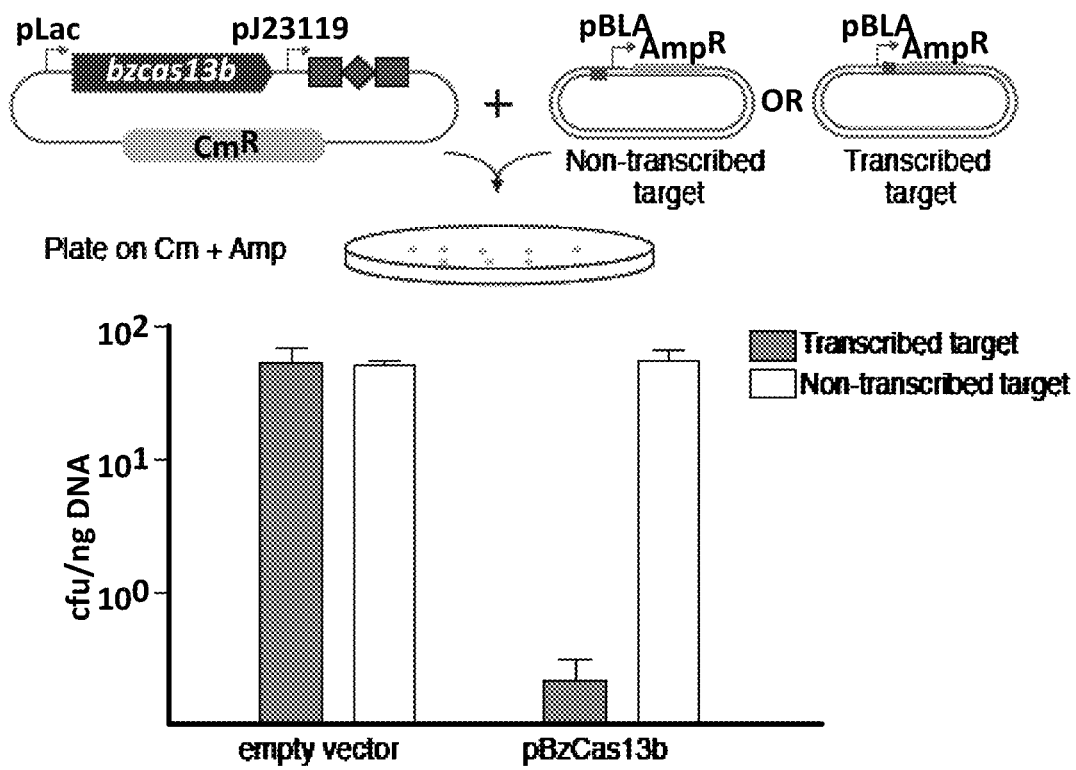
Figure 65D:
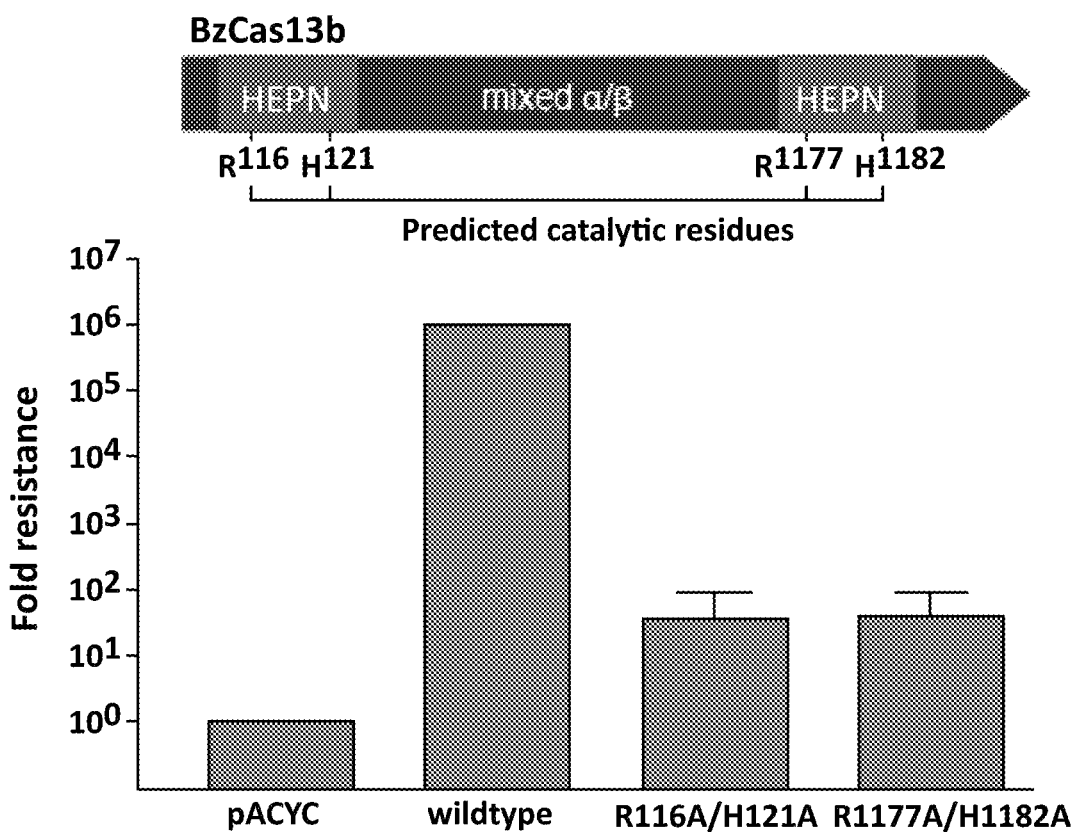
Figure 73:
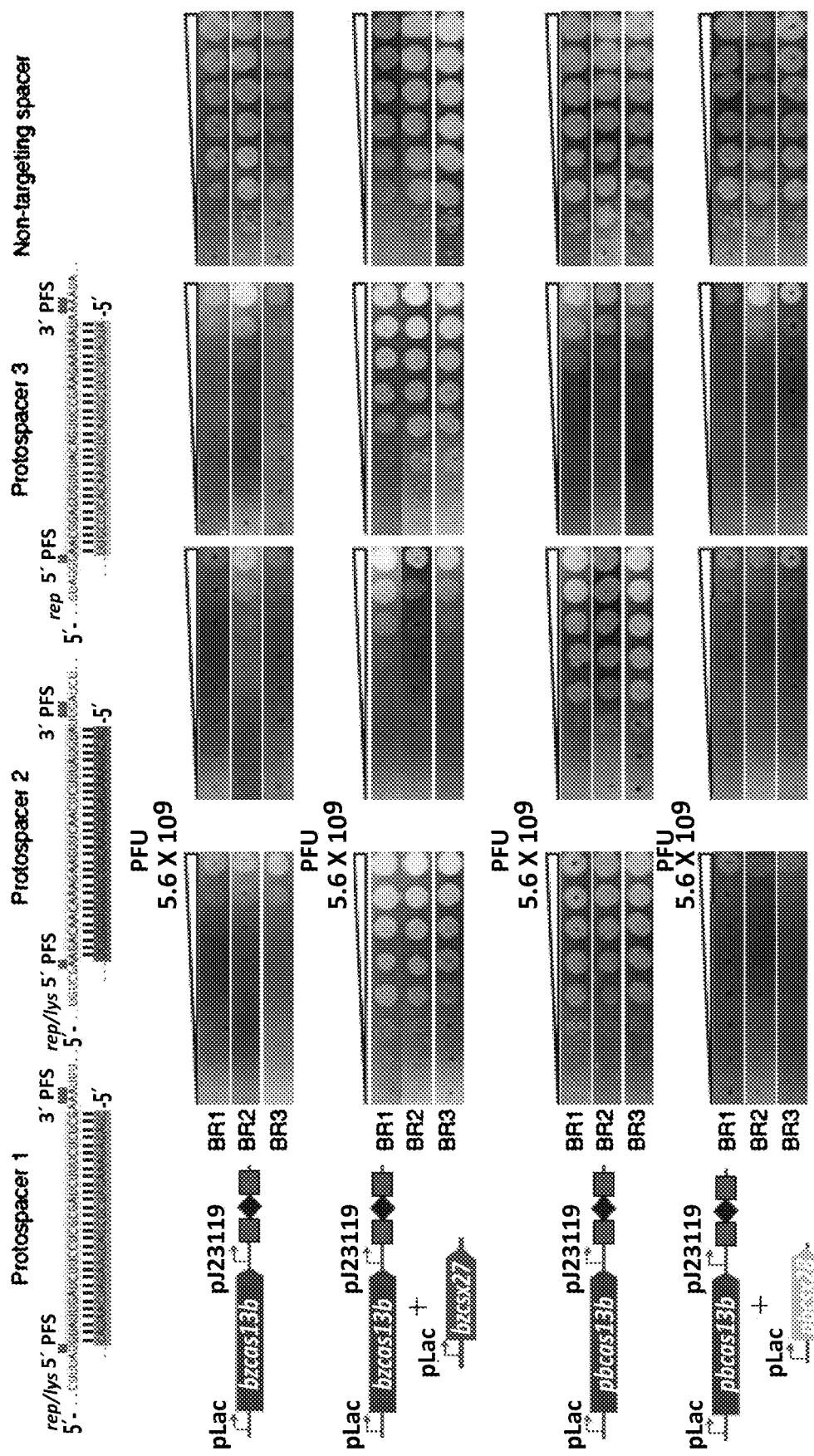
Figure 74:
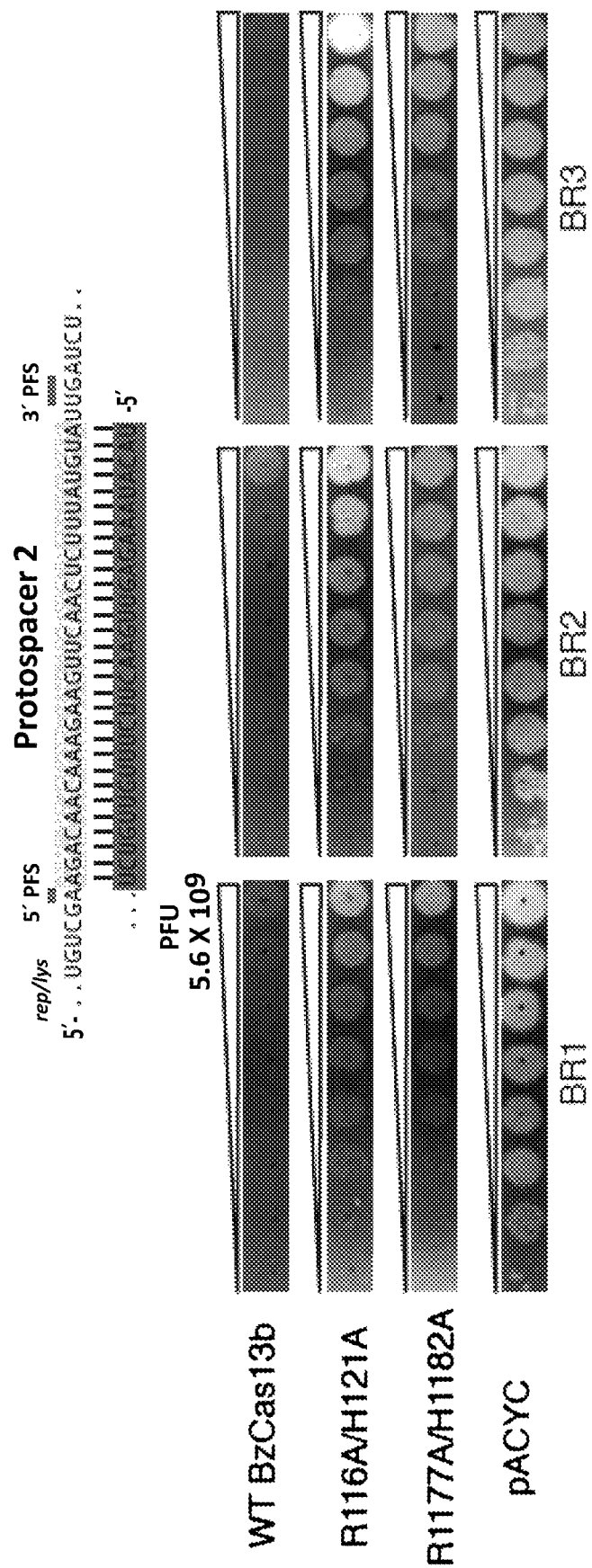

Based on the computationally predicted HEPN domains, which function as RNAses in other CRISPR-Cas systems such as VI-A, Applicants predicted that Cas13b interferes with RNA. To test this prediction, Applicants assayed interference against the lytic, single-stranded RNA bacteriophage MS2, whose life cycle contains no DNA intermediates. Applicants performed an MS2 drop plaque assay at serial dilutions of phage for both bzcas13b with bzcsx27 and bzcas13b alone with three spacers targeting the MS2 genome, two at the lys-rep interface and one in rep, and one non-targeting spacer (FIG. 65A). Upon completion of the assay, substantial reductions in plaque formation for all targeting spacers compared to the non-targeting spacer were observed, consistent with sequence-specific RNA targeting by VI-B1 systems. (FIG. 65B, FIG. 73). Notably, the presence of bzcsx27 appeared to weaken RNA interference by bzcas13b for all three spacers. Applicants confirmed the importance of the predicted enzymatic domains for interference by mutating the conserved, catalytic arginines and histidines in the two HEPN domains to alanine (R116A/H121A and R1177A/H1182A), leading to ~4.5 orders of magnitude decrease in resistance to MS2 phage (FIG. 65D, FIG. 74).

To rule out DNA interference as an additional mode of action, Applicants modified an existing plasmid interference assay with a protospacer placed either in-frame at the 5' end of the bla ampicillin-resistance gene transcript (transcribed target) or upstream of the bla gene promoter (non-transcribed target). Bacteria co-transformed with bzcas13b and spacer, as well as the non-transcribed target plasmid, survived at a comparable rate to co-transformation of the same target with the empty vector on dual antibiotic selection. For bacteria co-transformed with the transcribed target, the colony forming unit rate under dual antibiotic selection was reduced by ~2 orders of magnitude in the presence of bzcas13b, suggesting that Cas13b targets RNA exclusively (FIG. 65C).

Figure 66A:
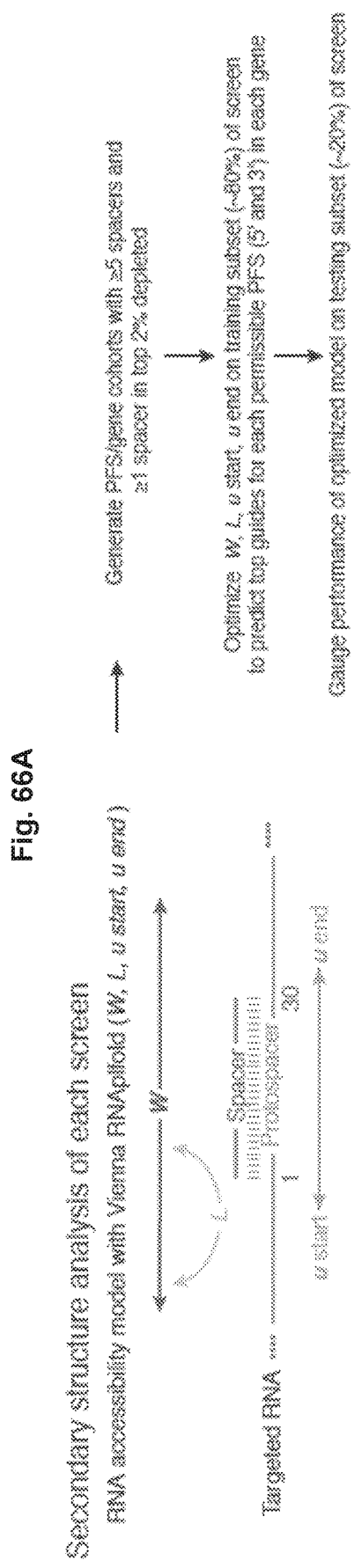
FIGS. 66A-66D show efficient RNA targeting by Cas13b correlated with local RNA accessibility.
Figure 66B:
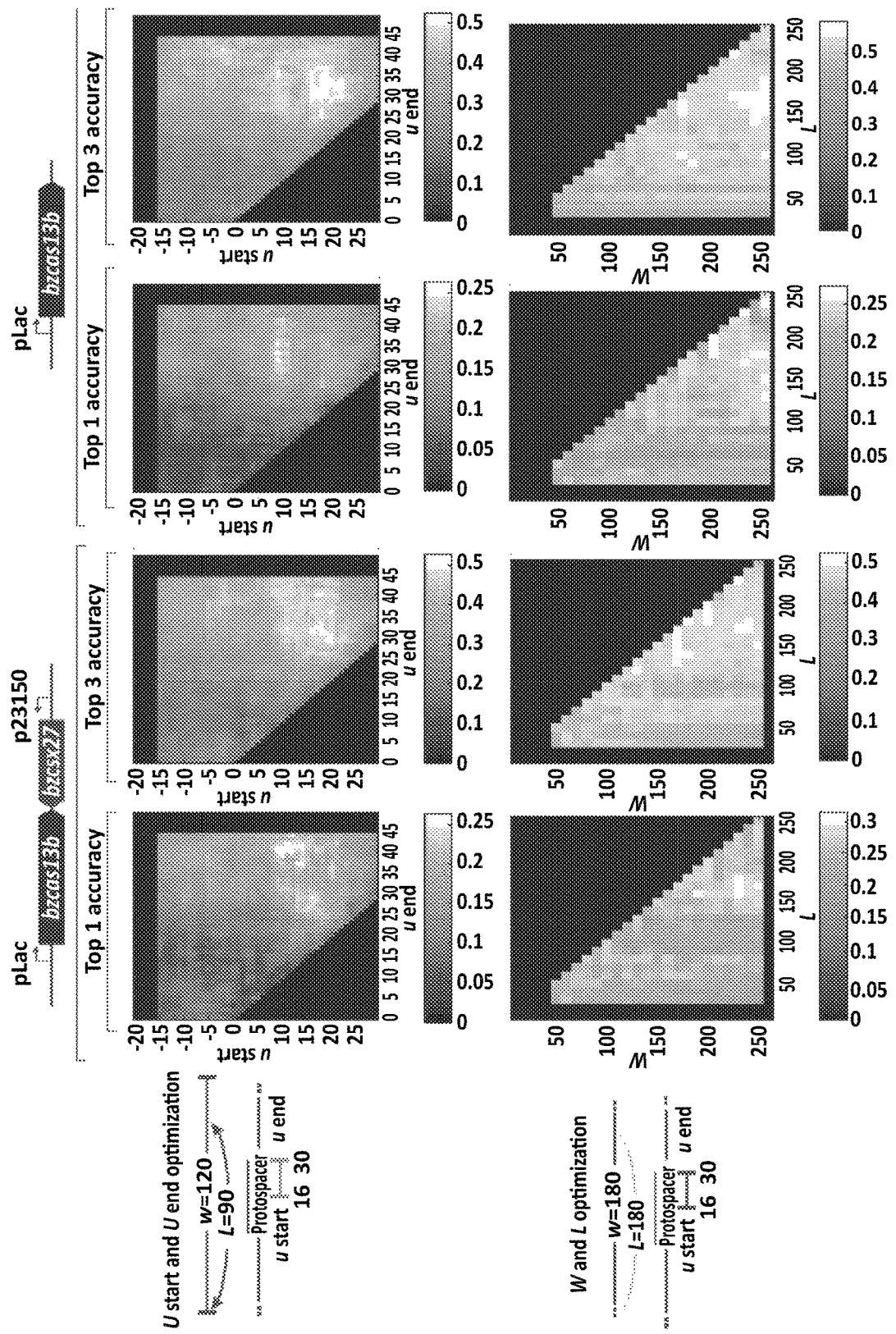
Figure 66C:
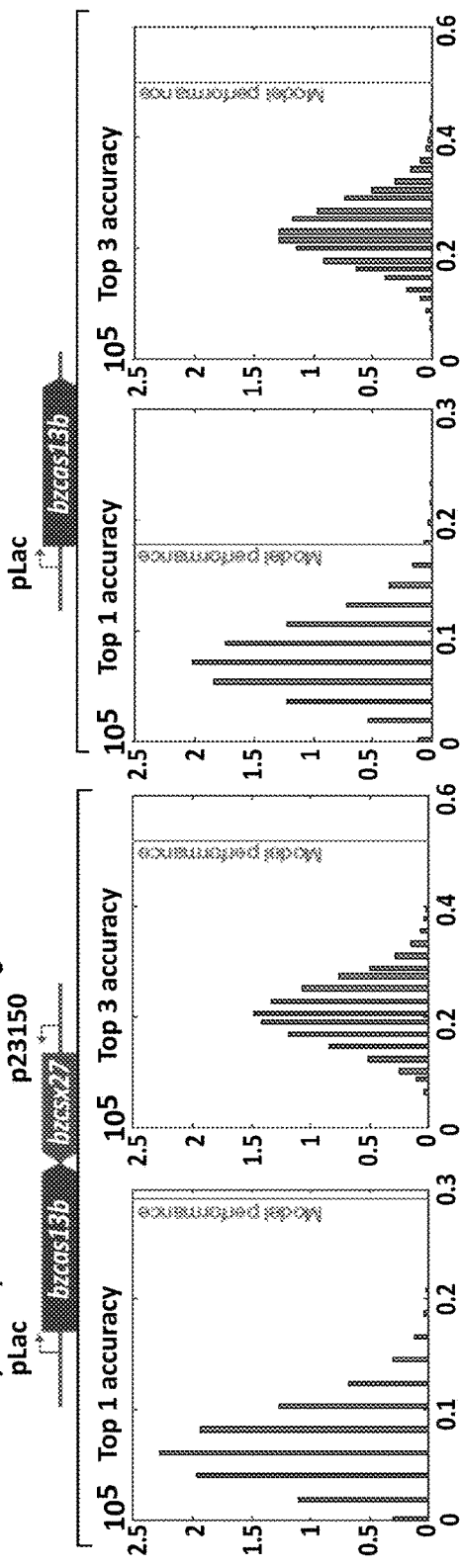
Figure 66D:
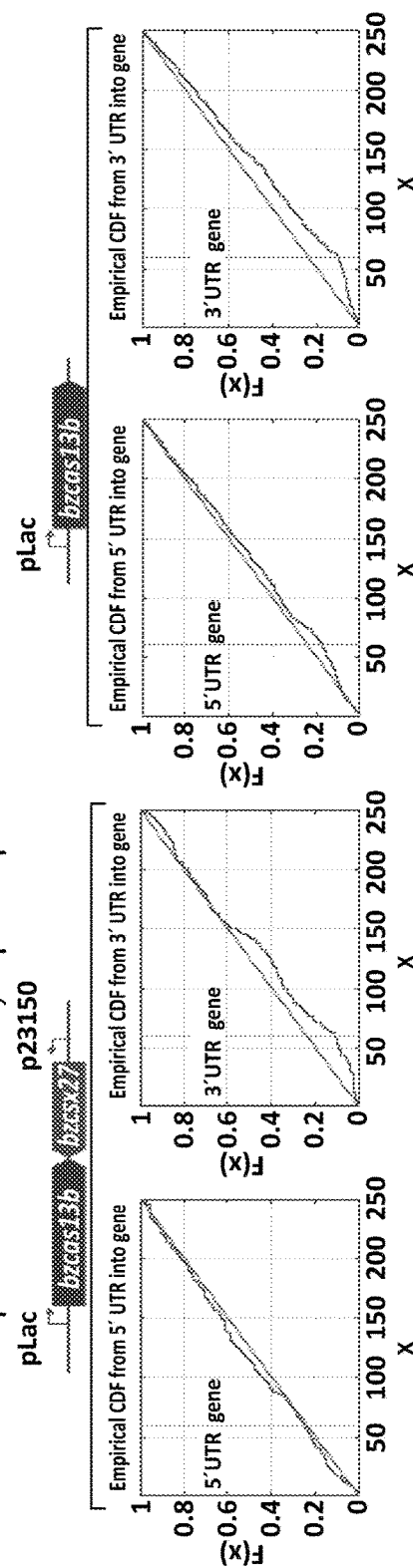

Given that RNA targets likely contain a variety of secondary structures and the results of the E. coli essential gene screen suggested that additional targeting rules beyond the PFS exist (only ~18% of spacers were safely depleted for bzcas13b; with sufficient gene essentiality the expected value would be ~33% from the PFS rule alone), Applicants sought to determine how RNA accessibility impacts targeting. Using the Vienna RNAplfold model (Bernhart et al., 2006), which has been successfully used to predict RNAi efficiency (Tafer et al., 2008), Applicants trained and tested the RNA accessibility model for spacer efficiency on the screen data, and found that RNA accessibility matters most in the protospacer region most distal to the direct repeat of the crRNA (FIG. 66B, 66C). Finally, Applicants calculated the empirical cumulative distribution functions of safely depleted spacers from 5' UTR into gene from 3' UTR into gene (FIG. 66D), finding marginal underrepresentation in spacers in the 3' UTR versus a uniform distribution, but otherwise no significant spatial dependence in spacer efficiency.

Figures 67C, 67D, 67E:
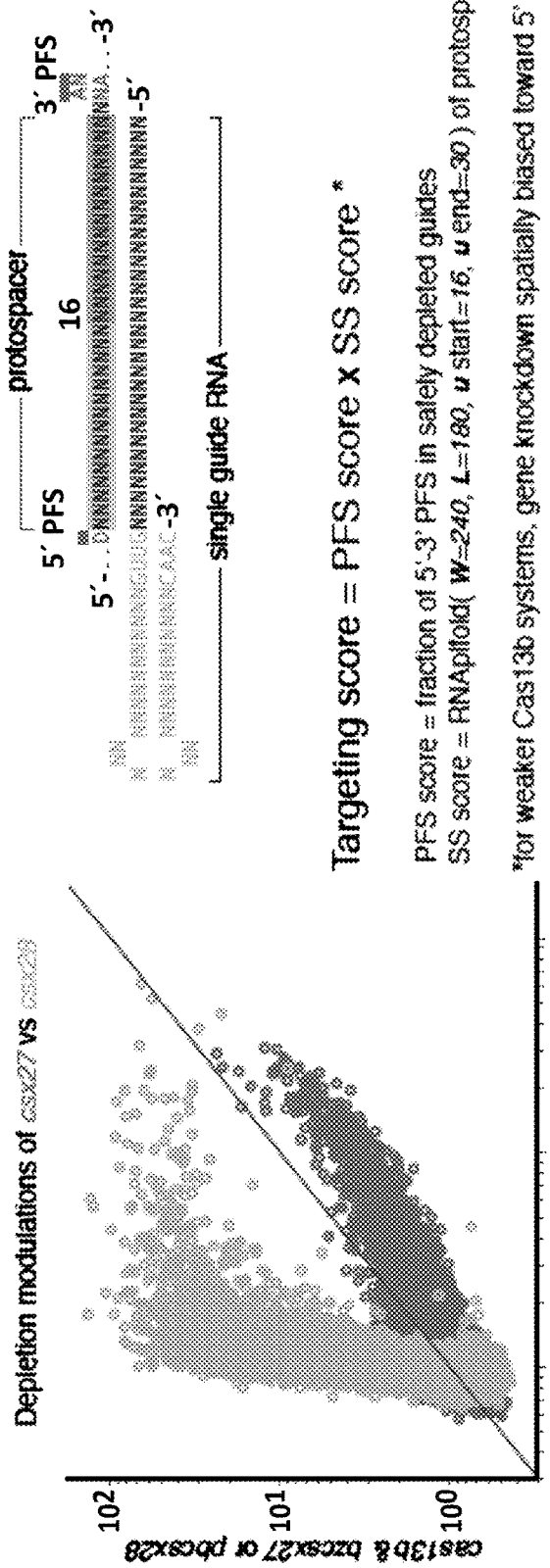
Figure 76A:
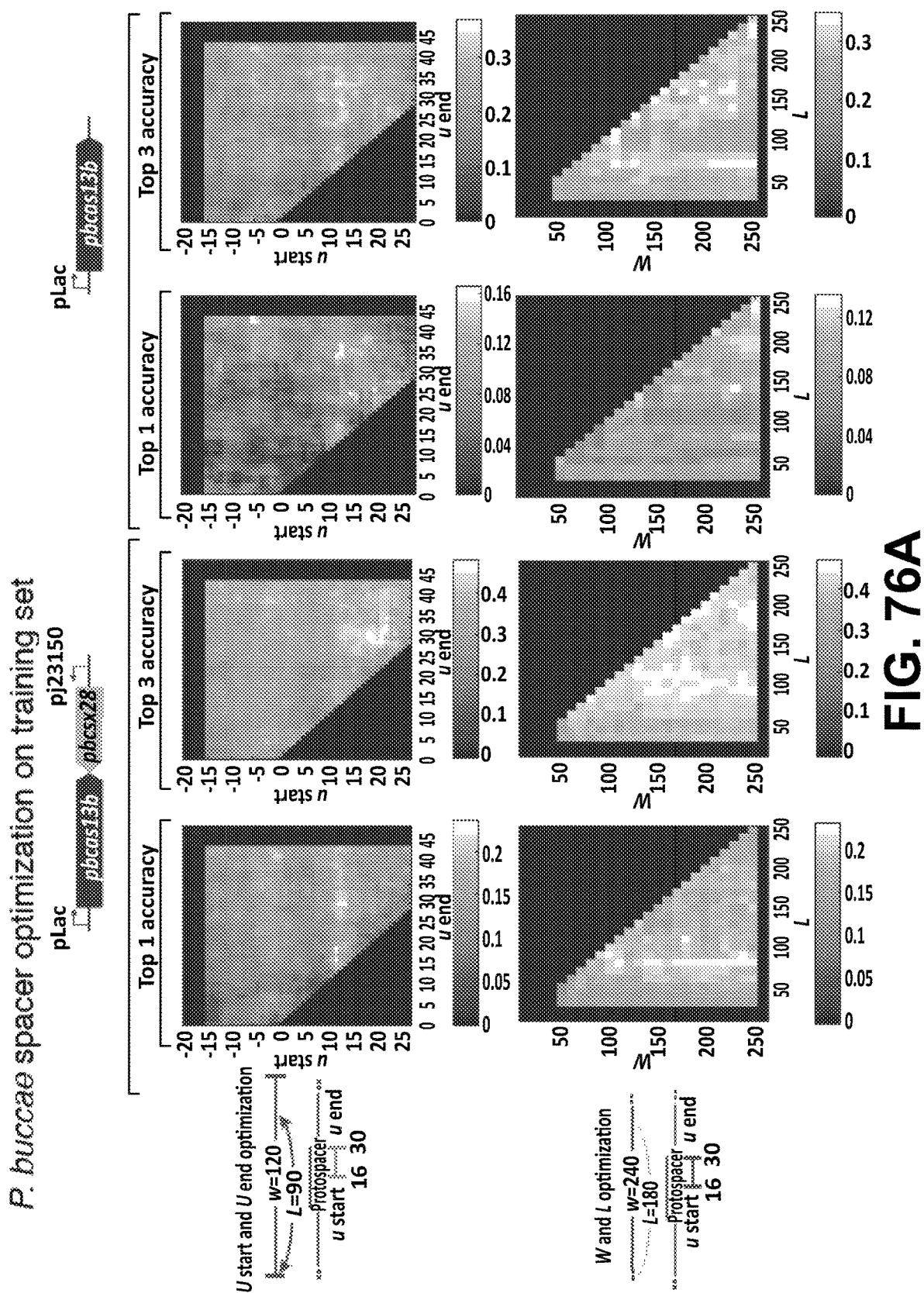
Figure 76B:
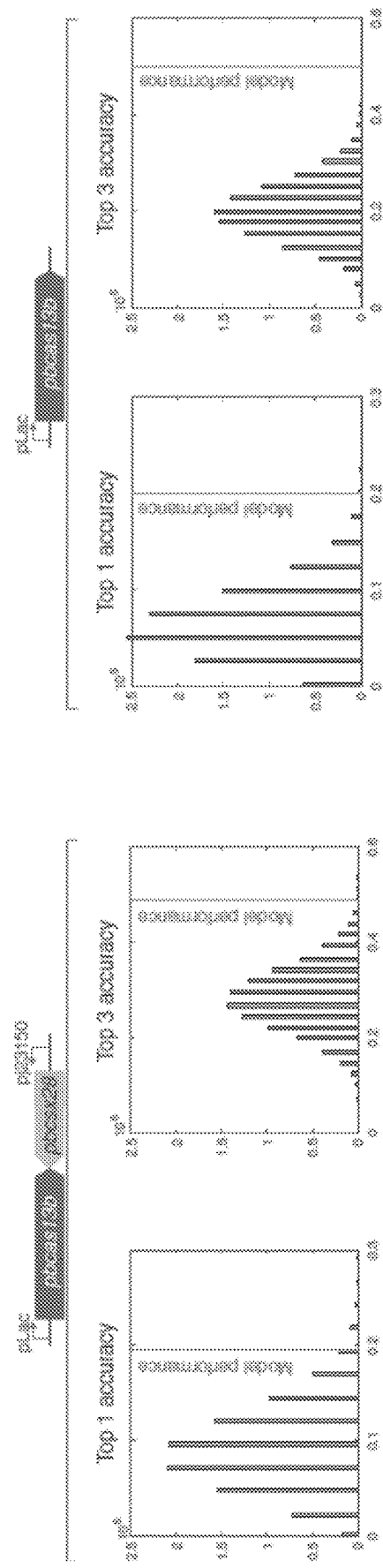
Figure 76C:
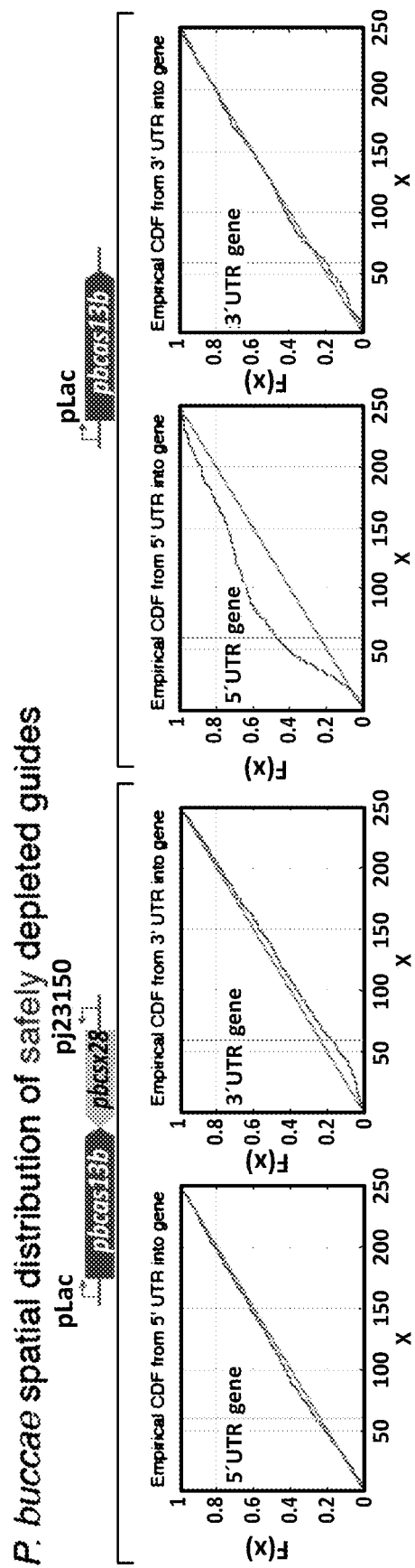

To determine if these RNA targeting rules generalize across type VI-B loci, Applicants next characterized the type VI-B2 locus from *P. buccae*. RNA sequencing of the CRISPR array revealed identical processing to that of *B. zoohelcum*, excluding the long crRNA (FIG. 47B). Performing the *E. coli* essential gene screen with pbcas13b and pbcsx28 or just pbcas13 revealed a similar PFS matrix to that of *B. zoohelcum*, with certain PFS's disfavored (FIG. 67A, FIG. 75). As with bzcsx27, the presence of pbcsx28 did not appreciably alter the PFS. Applicants also repeated the secondary structure analysis with pbcas13b, and a comparable RNAplfold model applied (FIG. 76A and B), but strikingly the safely depleted spacers for pbcas13b without pbcsx28 were highly biased to the 5' UTR of genes, suggestive of inhibited or more spatially localized RNase activity in the absence of pbcsx28 (FIG. 76C). Applicants confirmed the presumed reduced activity of pbcas13b relative to its full locus using the MS2 phage plaque drop assay, which showed that pbcsx28 enhances MS2 phage interference by up to four orders of magnitude (FIG. 67B, FIG. 73). The divergent ability of csx27 to repress and csx28 to enhance cas13b activity generalizes across thousands of spacers in the *E. coli* essential gene screen (FIG. 67C), highlighting a unique, bimodal property of type VI-B within Class 2 CRISPR-Cas systems.

Previous studies have shown that Cas13a exhibits non-specific RNase activity after target cleavage. Cas13b may possess similar collateral activity, in which case repression of Cas13b by Csx27 in VI-B1 systems could be an important regulatory mechanism (Makarova et al., 2009; Hayes et al., 2011). In the case of type VI-B2 systems, Csx28 might enhance Cas13b activity to overcome the numerous transcripts of invading bacteriophages or even to promote programmed cell death (Makarova et al., 2012), but this remains to be determined (FIG. 67E).

The novel, highly efficient, RNA-targeting Class 2 type VI-B CRISPR system resembles the previously described subtype VI-A in general functional scheme and effector protein architecture, but differs substantially in the specifics, in particular, by the apparent absence of local adaptation machinery and the presence of accessory proteins that modulate interference. The novel *E. coli* essential gene screen designed by Applicants provides a fast, unbiased, and reproducible method for elucidating the complex nucleic acid targeting rules of CRISPR-Cas systems and enabled the development of a multifaceted model for Cas13b RNA targeting dependent on sequence, structure, and space (FIG. 67D). An advanced understanding of the targeting rules of Cas13b and other RNA-targeting CRISPR systems raises the prospect of a new suite of precise and robust in vivo RNA manipulation tools for studying a wide range of biological processes.

```
Amino acid sequences of all Group 29 proteins:

>gi|34397202|gb|AAQ66265.1| hypothetical protein PG_1164
[Porphyromonas gingivalis W83] (SEQ ID NO: 31)
MNTVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHNLRKLLLMELLCEGSFSRMQSDFLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELHLLDPSSGHPFLSATMETAHRYTEDFYKCYLEKKREWLA
```

```
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
TLLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL

>gi|188594807|dbj|BAG33782.1| conserved hypothetical protein
[Porphyromonas gingivalis ATCC 33277]   (SEQ ID NO: 32)
MNTVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFAVFFKPDDFVLAKNRKEQLISVADGKECLIVSGFAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLDEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMDQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELRLLDPSSGHPFLSATMETAHRYTEGFYKCYLEKKREWLA
KIFYRPEQDENTKRRISVFFVPDGEARKLLPLLIRRRMKEQNDLQDWIRNKQAHPIDLPSHLFDSKVMEL
LKVKDGKKKWNEAFKDWWSTKYPDGMQPFYGLRRELNIHGKSVSYIPSDGKKFADCYTHLMEKTVRDKKR
ELRTAGKPVPPDLAADIKRSFHRAVNEREFMLRLVQEDDRLMLAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
TLLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL >gi|188595167|dbj|BAG34142.1| conserved hypothetical protein
[Porphyromonas gingivalis ATCC 33277] (SEQ ID NO: 33)
MTEQNERPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREEKVTEAGLLFFVSLFLEKRDAIWMQKKIRGFKGETYQQMTNEVFCRSRISLP
KLKLESLRIDDWMLLDMLNELVRCPKSLYDRLREEDRARFRVPVDILSDEDDIDGTEEDPFKNILVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRLTAEAFLS
VHELMPMMFYYFLLREKYSDEASAERVQGRIKRVIEDVYAVYDAFARGEINTRDELDACLADKGIRRGHL
PRQMIGILSQEHKDMEEKVRKKLQEMIVDTDHRLDMLDRQTDRKIFIGRKNAGLPKSGVIADWLVRDMMR
FQPVAKDTSGKPLNNSKANSTEYRMLQRALALFGGEKERLIPYFRQMNLIGGNNPHPFLHETRWESHTNI
LSFYRSYLKARKAFLQSIGRSDRVENHRFLLLKEPKTDRQTLVAGWKGEFHLPRGIFTEAVRDCLIEMGL
DEVGSYKEVGFMAKAVPLYFERACKDRVQPFYDYPFNVGNSLKPKKGRFLSKEKRAEEWESGKERFRLAK
LKKEILEAKEHPYLDFKSWQKFERELRLVKNQDIITWMICRDLMEENKVEGLDIGTLYLKDIRTDVQEQG
NLNVLNRVKPMRLPVVVYRADSRGHVHKEQAPLATVYIEERDTKLLKQGNFKSFVKDRRLNGLFSFVDTG
ALAMEQYPISKLRVEYELAKYQTARVCAFEQTLELEESLLTRYPHLPDKNFRKMLESWSDPLLDKWPDLH
GNVRLLIAVRNAFSHNQYPMYDEAVFSSIRKYDPSSPDAIEERMGLNIAHRLSEEVKQAKEMAERIIQA >gi|288336166|gb|EFC74556.1| putative phage head-tail adaptor
[Prevotella buccae D17]   (SEQ ID NO: 34)
MQKQDKLFVDRKKNAIFAFPKYITIMENQEKPEPIYYELTDKHFWAAFLNLARHNVYTTINHINRRLEIA
ELKDDGYMMDIKGSWNEQAKKLDKKVRLRDLIMKHFPFLEAAAYEITNSKSPNNKEQREKEQSEALSLNN
LKNVLFIFLEKLQVLRNYYSHYKYSEESPKPIFETSLLKNMYKVFDANVRLVKRDYMHHENIDMQRDFTH
LNRKKQVGRIKNIIDSPNFHYHFADKEGNMTIAGLLFFVSLFLDKKDAIWMQKKLKGFKDGRNLREQMIN
EVFCRSRISLPKLKLENVQTKDWMQLDMLNELVRCPKSLYERLREKDRESFKVPFDIFSDDYDAEEEPFK
NTLVRHQDRFPYFVLRYFDLNEIFEQLRFQIDLGTYHFSIYNKRIGDEDEVRHLTHHLYGFARIQDFAQQ
NQPEVWRKLVKDLDYFEASQEPYIPKTAPHYHLENEKIGIKFCSIHNNLFPSLKTEKTCNGRSKFNLGIQ
FTAEAFLSVHELLPMMFYYLLLIKDYSRKESADKVEGIIRKEISNIYAIYDAFANGEINSIADLICRLQK
TNILQGHLPKQMISILEGRQKDMEKEAERKIGEMIDDIQRRLDLLCKQINQKIRIGKRNAGLLKSGKIAD
WLVNDMMRFQPVQKDQNNIPINNSKANSTEYRMLQRALALFGSENFRLKAYFNQMNLVGNDNPHPFLAET
QWEHQTNILSFYRNYLEARKKYLKGLKPQNWKQYQHFLILKVQKTNRNTLVTGWKNSFNLPRGIFTQPIR
EWFEKHNNSKRIYDQILSFDRVGFVAKAIPLYFAEEYKDNVQPFYDYPFNIGNKLKPQKGQFLDKKERVE
LWQKNKELFKNYPSEKKKIDLAYLDFLSWKKFERELRLIKNQDIVTWLMFKELFNMATVEGLKIGEIHLR
DIDTNTANEESNNILNRIMPMKLPVKIYETDNKGNILKERPLATFYIEETETKVLKQGNFKVLAKDRRLN
GLLSFAETTDIDLEKNPITKLSVDHELIKYQTTRISIFEMTLGLEKKLINKYPTLPTDSFRNMLERWLQC
KANRPELKNYVNSLIAVRNAFSHNQYPMYDATLFAEVKKFTLFPSVDTKKIELNIAPQLLEIVGKAIKEI
EKSENKN >gi|312446353|gb|ADQ82708.1| hypothetical protein Riean_1551
[Riemerella anatipestifer ATCC 11845 = DSM 15868] (SEQ ID NO: 35)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFKHLYKAPFDASLRMVKEDYKAHFIVNLIRDFAHLNRKGKNKQDNPDFNRYR
FEKDGFFTESGLLFFINLFLDKRDAYWMLKKVSGFKASHKQREKMITEVFCRSRILLPKLRLESRYDHNQ
MLLDMLSELSRCPKLLYEKLSEENKKHFQVEADGFLDEIEEEQNPFKDTLIRHQDRFPYFALRYLDDLNES
FKSIRFQVDLGTYHYCIYDKKIGDEQEKRHLTRILLSFGRLQDFTEINRPQEWKALTKDLDYKETSNQPF
ISKTTPHYHITDNKIGFRLGTSKELYPSLEIKDGANRIAKYPYNSGFVAHAFISVHELLPLMFYQHLIGK
SEDLLKETVRHIQRIYKDFEEERINTIEDLEKANQGRLPLGAFPKQMLGLLQNKQPDLSEKAKIKIEKLI
AETKLLSHRLNIKLKSSPKLGKRREKLIKTGVLADWLVKDFMRFQPVAYDAQNQPIKSSKANSTEFWFIR
RALALYGGEKNRLEGYFKQINLIGNINPHPFLNKFNWKACRNLVDFYQQYLEQREKFLEAIKNQPWEPYQ
YCLLLKIPKENRKNLVKGWEQGGISLPRGLFTEAIRETLSEDLMLSKPIRKEIKKHGRVGFISRAITLYF
KEKYQDKHQSFYNLSYKLEAKAPLLKREEHYEYWQQNKPQSPTESQRLELHTSDRWKDYLLYKRWQHLEK
```

-continued
KLRLYRNQDVMLWLMTLELTKNHFKELNLNYHQLKLENLAVNVQEADAKLNPLNQTLPMVLPVKVYPATA
FGEVQYHKTPIRTVYIREEHTKALKMGNFKALVKDRRLNGLFSFIKEENDTQKHPISQLRLRRELEIYQS
LRVDAFKETLSLEEKLLNKHISLSSLENEFRALLEEWKKEYAASSMVIDEHIAFIASVRNAFCHNQYPFY
KEALHAPIPLFTVAQPITEEKDGLGIAEALLKVLREYCEIVKSQI >gi|315022569|gb|EFT35596.1| hypothetical protein RAYM_05191
[*Riemerella anatipestifer* RA-YM] (SEQ ID NO: 36)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFKHLYKAFDASLRMVKEDYKAHFIVNLIRDFAHLNRKGKNKQDNPDFNRYR
FEKDGFFTESGLLFFINLFLDKRDAYWMLKKVSGFKASHKQREKMITEVFCRSRILLPKLRLESRYDHNQ
MLLDMLSELSRCPKLLYEKLSEENKKHFQVEADGFLDEIEEEQNPFKDTLIRHQDRFPYFALRYLDLNES
FKSIRFQVDLGTYHYCIYDKKIGDEQEKRHLTRILLSFGRLQDFTEINRPQEWKALTKDLDYKETSNQPF
ISKTIPHYHITDNKIGFRLGTSKELYPSLEIKDGANRIAKYPYNSGFVAHAFISVHELLPLMFYQHLIGK
SEDLLKETVRHIQRIYKDFEEERINTIEDLEKANQGRLPLGAFPKQMLGLLQNKQPDLSEKAKIKIEKLI
AETKLLSHRLNIKLKSSPKLGKRREKLIKTGVLADWLVKDFMRFQPVAYDAQNQPIKSSKANSTEFWFIR
RALALYGGEKNRLEGYFKQINLIGNINPHPFLNKFNWKACRNLVDFYQQYLEQREKFLEAIKNQPWEPYQ
YCLLLKIPKENRKNLVKGWEQGGISLPRGLFTEAIRETLSEDLMLSKPIRKEIKKHGRVGFISRAITLYF
KEKYQDKHQSFYNLSYKLEAKAPLLKREEHYEYWQQNKPQSPTESQRLELHTSDRWKDYLLYKRWQHLEK
KLRLYRNQDVMLWLMTLELTKNHFKELNLNYHQLKLENLAVNVQEADAKLNPLNQTLPMVLPVKVYPATA
FGEVQYHKTPIRTVYIREEHTKALKMGNFKALVKDRRLNGLFSFIKEENDTQKHPISQLRLRRELEIYQS
LRVDAFKETLSLEEKLLNKHISLSSLENEFRALLEEWKKEYAASSMVIDEHIAFIASVRNAFCHNQYPFY
KEALHAPIPLFTVAQPITEEKDGLGIAEALLKVLREYCEIVKSQI >gi|315252008|gb|EFU31981.1| hypothetical protein HMPREF6485_0083
[*Prevotella buccae* ATCC 33574] (SEQ ID NO: 37)
MQKQDKLFVDRKKNAIFAFPKYITIMENKEKPEPIYYELTDKHFWAAFLNLARHNVYTTINHINRRLEIA
ELKDDGYMMGIKGSWNEQAKKLDKKVRLRDLIMKHFPPFLEAAAYEMINSKSPNNKEQREKEQSEALSLNN
LKNVLFIFLEKLQVLRNYYSHYKYSEESPKPIFETSLLKNMYKVFDANVRLVKRDYMHHENIDMQRDFTH
LNRKKQVGRIKNIIDSPNFHYHFADKEGNMTIAGLLFFVSLFLDKKDAIWMQKKLKGFKDGRNLREQMTN
EVFCRSRISLPKLKLENVQTKDWMQLDMLNELVRCPKSLYERLREKDRESFKVPFDIFSDDYNAEEEPFK
NTLVRHQDRFPYFVLRYFDLNEIFEQLRFQIDLGTYHFSIYNKRIGDEDEVRHLTHHLYGFARIQDFAPQ
NQPEEWRKLVKDLDHFETSQEPYISKTAPHYHLENEKIGIKFCSAHNNLFPSLQTDKICKGRSKFNLGTQ
FTAEAFLSVHELLPMMFYYLLLIKDYSRKESADKVEGIIRKEISNIIYDAFANNEINSIADLTRRLQN
TNILQGHLPKQMISILKGRQKDMGKEAERKIGEMIDDIQRRLDLLCKQINQKIRIGKRNAGLLKSGKIAD
WLVNDMMRFQPVQKDQNNIPINNSKANSTEYRMLQRALALFGSENFRLKAYFNQMNLVGNDNPHPFLAET
QWEHQTNILSFYRNYLEARKKYLKGLKPQNWKQYQHFLILKVQKTNRNTLVTGWKNSFNLPRGIFTQPIR
EWFEKHNNSKRIYDQILSFDRVGFVAKAIPLYFAEEYKDNVQPFYDYPFNIGNRLKPKKRQFLDKKERVE
LWQKNKELFKNYPSEKKKIDLAYLDFLSWKKFERELRLIKNQDIVTWLMFKELFNMATVEGLKIGEIHLR
DIDINTANEESSNNILNRIMPMKLPVKIYETDNKGNILKERPLATFYIEETETKVLKQGNFKALVKDRRLN
GLFSFAETTDLNLEEHPISKLSVDLELIKYQTTRISIFEMTLGLEKKLIDKYSTLPTDSFRNMLERWLQC
KANRPELKNYVNSLIAVRNAFSHNQYPMYDATLFAEVKKFTLPSVDTKKIELNIAPQLLEIVGKAIKEI
EKSENKN >gi|325335526|gb|ADZ11800.1| hypothetical protein RIA_0639 [*Riemerella
anatipestifer* RA-GD] (SEQ ID NO: 38)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFKHLYKAFDASLRMVKEDYKAHFIVNLIRDFAHLNRKGKNKQDNPDFNRYR
FEKDGFFTESGLLFFINLFLDKRDAYWMLKKVSGFKASHKQREKMITEVFCRSRILLPKLRLESRYDHNQ
MLLDMLSELSRCPKLLYEKLSEENKKHFQVEADGFLDEIEEEQNPFKDTLIRHQDRFPYFALRYLDLNES
FKSIRFQVDLGTYHYCIYDKKIGDEQEKRHLTRILLSFGRLQDFTEINRPQEWKALTKDLDYKETSNQPF
ISKTIPHYHITDNKIGFRLGTSKELYPSLEIKDGANRIAKYPYNSGFVAHAFISVHELLPLMFYQHLIGK
SEDLLKETVRHIQRIYKDFEEERINTIEDLEKANQGRLPLGAFPKQMLGLLQNKQPDLSEKAKIKIEKLI
AETKLLSHRLNIKLKSSPKLGKRREKLIKTGVLADWLVKDFMRFQPVAYDAQNQPIKSSKANSTEFWFIR
RALALYGGEKNRLEGYFKQINLIGNINPHPFLNKFNWKACRNLVDFYQQYLEQREKFLEAIKNQPWEPYQ
YCLLLKIPKENRKNLVKGWEQGGISLPRGLFTEAIRETLSEDLMLSKPIRKEIKKHGRVGFISRAITLYF
KEKYQDKHQSFYNLSYKLEAKAPLLKREEHYEYWQQNKPQSPTESQRLELHTSDRWKDYLLYKRWQHLEK
KLRLYRNQDVMLWLMTLELTKNHFKELNLNYHQLKLENLAVNVQEADAKLNPLNQTLPMVLPVKVYPATA
FGEVQYHKTPIRTVYIREEHTKALKMGNFKALVKDRRLNGLFSFIKEENDTQKHPISQLRLRRELEIYQS
LRVDAFKETLSLEEKLLNKHISLSSLENEFRALLEEWKKEYAASSMVIDEHIAFIASVRNAFCHNQYPFY
KEALHAPIPLFTVAQPITEEKDGLGIAEALLKVLREYCEIVKSQI >gi|333804399|dbj|BAK25606.1| hypothetical protein PGTDC60_1457
[*Porphyromonas gingivalis* TDC60] (SEQ ID NO: 39)
MTEQNEKPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKNKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREGIVTEAGLLFFVSLFLEKRDAIWMQKKIRGFKGGTETYQQMINEVFCRSRISLP
KLKLESLRIDDWMLLDMLNELVRCPKSLYDRLREEDRARFRVPVDILSDEEDIDGAEEDPFKNILVRHQD
RPFYFALRYFDLKKVFTSLRFQIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRFTAEAFLS
AHELMPMMFYYFLLREKYSEEASAERVQGRIKRVIEDVYAVYDAFARDEINTRDELDACLADKGIRRGHL
PRQMIGILSQEHKDMEEKIRRKLQEMMADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDRVENHRFLLLKEPKTDRQTLVAGWKGEFHLPRGIFTEAVRDCLIEMGL
DEVGSYKEVGFMAKAVPLYFERACKDWVQPFYNYPFNVGNSLKPKKGRFLSKEKRAEEWESGKERFRLAK
LKKEILEAKEHPYLDFKSWQKFERELRLVKNQDIITWMICGDLMEENKVEGLDIGTYLKDIRTDVQEQG
SLNVLNRVKPMRLPVVVYRADSRGHVHKEQAPLATVYIEERDTKLLKQGNFKSFVKDRRLNGLFSFVDTG
ALAMEQYPISKLRVEYELAKYQTVCAFEQTLELEESSLLTRCPHLPDKNFRKMLESWSDPLLDKWPDLH
RKVRLLIAVRNAFSHNQYPMYDEAVFSSIRKYDPSFPDAIEERMGLNIAHRLSEEVKQAKETVERIQA -continued >gi|339613716|gb|EGQ18444.1| hypothetical protein HMPREF9144_1146
[*Prevotella pallens* ATCC 700821] (SEQ ID NO: 40)
MKEEEKGKTPVVSTYNKDDKHFWAAFLNLARHNVYITVNHINKILGEGEINRDGYENTLEKSWNEIKDIN
KKDRLSKLIIKHFPFLEVITYQRNSADTTKQKEEKQAEAQSLESLKSFFVFIYKLRDLRNHYSHYKHSK
SLERPKFEEDLQEKMYNIFDASIQLVKEDYKHNTDIKTEEDFKHLDRKGQFKYSFADNEGNITESGLLFF
VSLFLEKKDAIWVQKKLEGFKCSNESYQKMTNEVFCRSRMLLPKLRLQSTQTQDWILLDMLNELIRCPKS
LYERLREEDRKKFRVPIEIADEDYDAEQEPFKNALVRHQDRFPYFALRYFDYNEIFTNLRFQIDLGTYHF
SIYKKQIGDYKESHHLTHKLYGFERIQEFTKQNRPDEWRKFVKIFNSFETSKEPYIPETTPHYHLENQKI
GIRFRNDNDKIWPSLKINSEKNEKSKYKLDKSFQAEAFLSVHELLPMMFYYLLLKTENTDNDNEIETKKK
ENKNDKQEKHKIEEIIENKITEIYALYDAFANGKINSIDKLEEYCKGKDIEIGHLPKQMIAILKSEHKDM
ATEAKRKQEEMLADVQKSLESLDNQINEEIENVERKNSSLKSGEIASWLVNDMMRFQPVQKDNEGNPLNN
SKANSTEYQMLQRSLALYNKEEKPTRYFRQVNLIESSNPHPFLNNTEWEKCNNILSFYRSYLEAKKNFLE
SLKPEDWEKNQYFLMLKEPKINCETLVQGWKNGFNLPRGIFTEPIRKWFMEHRKNITVAELKRVGLVAKV
IPLFFSEEYKDSVQPFYNYLFNVGNINKPDEKNFLNCEERRELLRKKKDEFKKMTDKEKEENPSYLEFQS
WNKFERELRLVRNQDIVTWLLCMELFNKKKIKELNVEKIYLKNININTIKKEKNTEEKNGEEKIIKEKNN
ILNRIMPMRLPIKVYGRENFSKNKKKKIRRNIFFTVYIEEKGTKLLKQGNFKALERDRRLGGLFSFVKTH
SKAESKSNTISKSRVEYELGEYQKARIEIIKDMLALEETLIDKYNSLDIDNFHNMLIGWLKLKDEPDKAS
FQNDVDLLIAVRNAFSHNQYPMRNRIAFANINPFSLSSANTSEEKGLGIANQLKDKIHKTIEKIIEIEKP
IETKE >gi|339902202|gb|AEK23281.1| Hypothetical protein Ccan_11650
[*Capnocytophaga canimorsus* Cc5] (SEQ ID NO: 41)
MKNIQRLGKGNEFSPFKKEDKYFGGFLNLANNNIEDFFKEIITREGIVITDENKKPKETFGEKILNEIF
KKDISIVDYEKWVNIFADYFPFTKYLSLYLEEMQFKNRVICFRDVMKELLKTVEALRNFYTHYDHEPIKI
EDRVFYFLDKVLLDVSLIVKNKYLKTDKIKEFLNQHIGEELKELCKQRKDYLVGKGKRIDKESEIINGIY
NNAFKDFICKREKQDDKENHNSVEKILCNKEPQNKKQKSSATVWELCSKSSSKYTEKSFPNRENDKHCLE
VPISQKGIVFLLSFFLNKGEIYALTSNIKGPFKAKITKEEPVTYDKNSIRYMATHRMFSFLAYKGLKRKIR
TSEINYNEDGQASSTYEKETLMLQMLDELNKVPDVVYQNLSEDVQKTFIEDWNEYLKENNGDVGTMEEEQ
VIHPVIRKRYEDKFNYFAIRFLDEFAQFPILRFQVHLGNYLCDKRTKQICDTTTEREVKKKITVFGRLSE
LENKKAIFLNEREEIKGWEVFPNPSYDFPKENISVNYKDFPIVGSILDREKQPVSNKIGIRVKIADELQR
EIDKAIKEKKLRNPKNRKANQDEKQKERLVNEIVSINSNEQGEPVVFIGQPTAYLSMNDIHSVLYEFLIN
KISGEALETKIVEKIETQIKQIIGKDATTKILKPYTNANSNSINREKLLRDLEQEQQILKILLEEQQQRE
KDKKDKKSKRKHELYPSEKGKVAVWLANDIKREMPKAFKEQWRGYHHSLLQKYLAYYEQSKEELKNLLPK
EVFKHFPFKLKGYFQQQYLNQFYIDYLKRRLSYVNELLLNIQNFKNDKDALKATEKECFKFFRKQNYIIN
PINIQISILVYPIFLKRGFLDEKPIMIDREKFKENKDTELADWFMHYKNYKEDNYQKFYAYPLEKVEEK
EKFKRNKQINKQKKNDVYTLMMVEYIIQKIFGDKFVEENPLVLKGIFQSKAERQQNNTHAATTQERNLNG
ILNQPKDIKIQGKITVKGVKLKDIGNFRKYEIDQRVNTFLDYEPRKEWMAYLPNDWKEKEKQGQLPPNNV
IDRQISKYETVRSKILLKDVQELEKIISDEIKEEHRHDLKQGKYYNFKYYILNGLLRQLKNENVENYKVF
KLNINPEKVNITQLKQEATDLEQKAFVLTYIRNKFAHNQLPKKEFWDYCQEKYGKIEKEKTYAEYFAEVF
KREKEALIK >gi|365737173|gb|AEW86266.1| hypothetical protein FCOL_07235
[*Flavobacterium columnare* ATCC 49512] (SEQ ID NO: 42)
MSSKNESYNKQKTFNHYKQEDKYFFGGFLNNADDNLRQVGKEFKTRINFNHNNNELASVFKDYFNKEKSV
AKREHALNLLSNYFPVLERIQKHINHNFEQTREIFELLLDTIKKLRDYYTHHYHKPITINPKIYDFLDDT
LLDVLITIKKKKVKNDTSRELLKEKLRPELTQLKNQKREELIKKGKKLLEENLENAVFNHCLRPFLEENK
TDDKQNKTVSLRKYRKSKPNEETSITLIQSGLVFLMSFFLHRKEFQVFTSGLEGFKAKVNTIKEEEISLN
KNNIVYMITHWSYSYYNFKGLKHRIKTDQGVSTLEQNNITHSLINTNIKEALLTQIVDYLSKVPNEIYET
LSEKQQKEFEEDINEYMRENPENEDSTFSSIVSHKVIRKRYENKFNYFAMRFLDEYAELPTLRFMVNFGD
YIKDRQKKILESIQFDSERIIKKEIHLFEKLSLVTEYKKNVLKKETSNIDLSRFPLFPNPSYVMANNNIP
FYIDSRSNNLDEYLNQKKKAQSQNKKRNLIFEKYNKEQSKDAIIAMLQKEIGVKDLQQRSTIGLLSCNEL
PSMLYEVIVKDIKGAELENKIAQKIREQYQSIRDFILDSPQKDNIPTTLIKTINTDSSVIFENQPIDIPR
LKNAIQKELTLIQEKLLNVKEHEIEVDNYNRNKNTYKFKNQPKNKVDDKKLQRKYVFYRNEIRQEANWLA
SDLIHFMKNKSLWKGYMHNELQSFLAFFEDKKNDCIALLETVFNLKEDCILTKGLKNLFLKHGNFIDFYK
EYLKLKEDFLNTESTFLENGLIGLPPKILKKELSKRFKYIFIVFQKRQFIIKELEEKKNNLYADAINLSR
GIFDEKPIMIPFKKPNPDEFASWFVASYQYNNYQSFYELTPDIVERDKKKKYKNLRAINKVKIQDYYLKL
MVDTLYQDLFNQPLDKSLSDFYVSKAEREKIKADAKAYQKRNDSSLWNKVIHLSLQNNRITANPKLKDIG
KYKRALQDEKIAILLTYDDRIWTYALQKPEKENENDYKELHYTALNMELQEYEKVRSKELLKQVQELEKQ
ILEEYTDFLSTQIHPADFEREGNPNFKKYLAHSILENEDDLDKLPEKVEAMRELDETITNPIIKKAIVLI
IIRNKMAHNQYPPKFIYDLANRFVPKKEEEYFATYFNRVFETITKELWENKEKKDKTQV >gi|371640969|gb|EH006562.1| hypothetical protein HMPREF9712_03108
[*Myroides odoratimimus* CCUG 10230] (SEQ ID NO: 43)
MKDILTTDDTTEKQNRFYSHKIADKYFFGGYFNLASNNIYEVFEEVNKRNIFGKLAKRDNGNLKNYIIHVF
KDELSISDFEKRVAIFASYFPILETVDKKSIKERNRTIDLILSQRIRQFREMLISLVTAVDQLRNFYTHY
HHSDIVIENKVLDFLNSSFVSTALHVKDKYLKTDKIKEFLKETIAAELDILIEAYKKKQIEKKNTRFKAN
KREDILNAIYNEAFWSFINDKDKDKDKETVVAKGADAYFEKNHHKSNDPDFALNISEKGIVYLLSFFLIN
KEMDSLKANLIGFKGKVDRESGNSIKYMATQRIYSFHTYRGLKQKIRTSEEGVKEILLMQMIDELSKVPN
VVYQHLSTIQQNSFIEDWNEYYKDYEDDVETDDLSRVIHPVIRKRYEDRFNYFAIRFLDEFFDFPILRFQ
VHLGDYVHDRRIKQLGKVESDRIIKEKVIVFARLKDINSAKASYFHSLEEQDKEELDNKWILFPNPSYDF
PKEHTLQHQGEQKNAGKIGIYVKLRDTQYKEKAALEEARKSLNPKERSATKASKYDIITQIIEANDNVKS
EKPLVFIGQPIAYLSMNDIHSMLFSLLIDNAELKKTPEEVEAKLIDQIGKQINEILSKDIDTKILKKYKD
NDLKETDIDKITRDLARDKEEIEKLILEQKQRADDYNYISSTKFNIDKSRKRKHLLFNAEKGKIGVWLAN
DIKRFMFKESKSKWKGYQHTELQKLFAYFDTSKSDLELILSNMVMVKDYPIELIDLVKKSRILVDFLNKY
LEARLEYIENVITRVKNSIGTPQFKIVRKECPTFLKKSNYTVVSLDKQVERILSMPLFIERGFMDDKPTM
LEGKSYKQHKEKFADWFVHYKENSNYQNFYDIEVYEITTEDKREKAKVIKKIKQQQKNDVFILMMVNYML
EEVLKLSSNDRLSLNELYQTKEERIVNKQVAKDTQERNKNYIWNKVVDLQLCDGLVHIDNVKLKDIGNFR
KYENDSRVKEFLTYQSDIVWSAYLSNEVDSNKLYVIERQLDNYESIRSKELLKEVQEIECSVYNQVANKE
SLKQSGNENFKQYVLQGLLPIGMDVREMLILSTDVKFKKEEIIQLGQAGEVEQDLYSLIYIRNKFAHNQL
PIKEFFDFCENNYRSISDNEYYAEYYMEIFRSIKEKYAN -continued >gi|380461034|gb|AFD56718.1| hypothetical protein RA0C_1842
[*Riemerella anatipestifer* ATCC 11845 = DSM 15868] (SEQ ID NO: 44)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFKHLYKAFDASLRMVKEDYKAHFIVNLIRDFAHLNRKGKNKQDNPDFNRYR
FEKDGFFTESGLLFFINLFLDKRDAYWMLKKVSGFKASHKQREKMITEVFCRSRILLPKLRLESRYDHNQ
MLLDMLSELSRCPKLLYEKLSEENKKHFQVEADGFLDEIEEEQNPFKDTLIRHQDRFPYFALRYLDLNES
FKSIRFQVDLGTYHYCIYDKKIGDEQEKRHLTRILLSFGRLQDFTEINRPQEWKALTKDLDYKETSNQPF
ISKTIPHYHITDNKIGFRLGTSKELYPSLEIKDGANRIAKYPYNSGFVAHAFISVHELLPLMFYQHLIGK
SEDLLKETVRHIQRIYKDFEEERINTIEDLEKANQGRLPLGAFPKQMLGLLQNKQPDLSEKAKIKIEKLI
AETKLLSHRLNIKLKSSPKLGKRREKLIKTGVLADWLVKDFMRFQPVAYDAQNQPIKSSKANSTEFWFIR
RALALYGGEKNRLEGYFKQINLIGNINPHPFLNKFNWKACRNLVDFYQQYLEQREKFLEAIKNQPWEPYQ
YCLLLKIPKENRKNLVKGWEQGGISLPRGLFTEAIRETLSEDLMLSKPIRKEIKKHGRVGFISRAITLYF
KEKYQDKHQSFYNLSYKLEAKAPLLKREEHYEYWQQNKPQSPTESQRLELHTSDRWKDYLLYKRWQHLEK
KLRLYRNQDVMLWLMTLELTKNHFKELNLNYHQLKLENLAVNVQEADAKLNPLNQTLPMVLPVKVYPATA
FGEVQYHKTPIRTVYIREEHTKALKMGNFKALVDRRLNGLFSFIKEENDTQKHPISQLRLRRELEIYQS
LRVDAFKETLSLEEKLLNKHISLSSLENEFRALLEEWKKEYAASSMVIDEHIAFIASVRNAFCHNQYPFY
KEALHAPIPLFTVAQPITEEKDGLGIAEALLKVLREYCEIVKSQI >gi|386374623|gb|AFJ07523.1| hypothetical protein PIN17_0200
[*Prevotella intermedia* 17] (SEQ ID NO: 45)
MKMEDDKKIKESTNMLDNKHFWAAFLNLARHNVYITVNHINKVLELKNKKDQDIIIDNDQDILAIKTHWE
KVNGDLNKTERLRELMTKHFPPFLETAIYIKNKEDKEEVKQEKQAKAQSFDSLKHCLFLFLEKLQEARNYY
SHYKYSESTKEPMLEKELLKKMYNIFDDNIQLVIKDYQHNKDINPDEDFKHLDRTEEEFNYYFTINKKGN
ITASGLLFFVSLFLEKKDAIWMQQKLRGFKDNRESKKKMTHEVFCRSRMLLPKLRLESTQTQDWILLDML
NELIRCPKSLYERLQGEYRKKENVPFDSADEDYDAEQEPFKNILVRHQDRFPYFALRYFDYNEIFTNLRF
QIDLGTYHFSIYKKLIGGQKEDRHLTHKLYGFERIQEFAKQNRIDEWKAIVKDFDIYETSEEPYISETAP
HYHLENQKIGIRFRNDNDEIWPSLKINGENNEKRKYKLDKQYQAEAFLSVHELLPMMFYYLLLKKEEPNN
DKKNASIVEGFIKREIRDIYKLYDAFANGEINNIDDLEKYCEDKGIPKRHLPKQMVAILYDEHKDMAEEA
KRKQKEMVKDIKKLLATLEKQTQGEIEDGGRNIRLLKSGEIARWLVNDMMRFQPVQKDNEGNPLNNSKAN
STEYQMLQRSLALYNKEEKPTRYFRQVNLINSSNPHPFLKWIKWEECNNILSFYRSYLIKKIEFLNKLKP
EDWEKNQYFLKLKEPKTNRETLVQGWKNGFNLPRGIFTEPIREWFKRHQNDSEEYEKVETLDRVGLVTKV
IPLFFKKEDSKDKEEYLKKDAQKEINNCVQPFYGFPYNVGNIHKPCEDFLPSEERKKLWGDKKYKPKGY
KAKVKSKKLIDKEKEEYRSYLEFQSWNKFERELRLVRNQDIVTWLLCTELIDKLKVEGLNVEELKKLRLK
DIDIDTAKQEKNNILNRVMPMQLPVIVYEIDDSHNIVKDRPLHIVYIEETKIKLLKQGNFKALVDRRLN
GLFSFVDTSSETELKSNPISKSLVEYELGEYQNARIETIKDMLLLEETLIEKYKTLPIDNFSDMLNGWLE
GKDEADKARFQNDVKLLVAVRNAFSHNQYPMRNRIAFANINPFSLSSADTSEEKKLDIANQLKDKIHKII
KRIIEIEKPIETKE >gi|392610411|gb|EIW93190.1| hypothetical protein HMPREF1322_2050
[*Porphyromonas gingivalis* W50] (SEQ ID NO: 46)
MTEQNEKPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDSVQRVKRDHEHNDKVDPHRHFNHLVRKGKKDKY
GNNDNPFFKHHFVDREEKVTEAGLLFFVSLFLEKRDAIWMQKKIRGFKGGTEAYQQMTNEVFCRSRISLP
KLKLESLRIDDWMLLDMLNELVRCPKSLYDRLREEDRARFRVPVDILSDEDDIDGTEEDPFKNILVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQLLWPSPEVGATRTGRSKYAQDKRFTAEAFLS
VHELMPMMFYYFLLREKYSEEASAEKVQGRIKRVIEDVYAVYDAFARDEINTRDELDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDREENHRFLLLKEPKTDRQTLVAGWKSEFHLPRGIFTEAVRDCLIEMGY
DEVGSYKEVGFMAKAVPLYFERACKDRVQPFYDYPFNVGNSLKPKKGRFLSKEKRAEEWESGKERFRDLE
AWSHSAARRIEDAFVGIEYASWENKKKIEQLLQDLSLWETFESKLKVKADKINIAKLKKEILEAKEHPYH
DFKSWQKFERELRLVKNQDIITWMMCRDLMEENKVEGLDIGTLYLKDIRTDVQEQGSLNVLNHVKPMRLP
VVVVYRADSRGHVHKEEAPLATVYIEERDTKLLKQGNFKSFVKDRRLNGLFSFVDTGALAMEQYPISKLRV
EYELAKYQTARVCAFEQTLELEESLLTRYPHLPDESFREMLESWSDPLLDKWPDLQREVRLLIAVRNAFS
HNQYPMYDETIFSSIRKYDPSSLDAIEERMGLNIAHRLSEEVKLAKEMVERIIQA >gi|392612061|gb|EIW94777.1| hypothetical protein HMPREF1322_1926
[*Porphyromonas gingivalis* W50] (SEQ ID NO: 47)
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHNLRKLLLMELLCEGSFSRMQSDFLRKANRILDETAE
GKLQFSALFPEMRHRFIPPQNPKSKDRREKAETTLEKYKQEIGKRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELHLLDPSSGHPFLSATMETAHRYTEDFYKCYLEKKREWLA
KTFYRPEQDENTKRRISVFFVPDGEARKLLPLLIRRRMKEQNLQPDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL \>gi|400374977|gb|EJP27887.1| hypothetical protein HMPREF1146_2324
[*Prevotella* sp. MSX73] (SEQ ID NO: 48)
MQKQDKLFVDRKKNAIFAFPKYITIMENQEKPEPIYYELTDKHFWAAFLNLARHNVYTTINHINRRLEIA
ELKDDGYMMGIKGSWNEQAKKLDKKVRLRDLIMKHFPFLEAAAYEITNSKSPNNKEQREKEQSEALSLNN
LKNVLFIFLEKLQVLRNYYSHYKYSEESPKPIFETSLLKNMYKVFDANVRLVKRDYMHHENIDMQRDFTH
LNRKKQVGRIKNIIDSPNFHYHFADKEGNMTIAGLLFFVSLFLDKKDAIWMQKKLKGFKDGRNLREQMIN
EVFCRSRISLPKLKLENVQTKDWMQLDMLNELVRCPKSLYERLREKDRESFKVPFDIFSDDYDAEEEPFK
NTLVRHQDRFPYFVLRYFDLNEIFEQLRFQIDLGTYHFSIYNKRIGDEDEVRHLTHHLYGFARIQDFAPQ
NQPEEWRKLVKDLDHFETSQEPYISKTAPHYHLENEKIGIKFCSIHNNLFPSLKREKTCNGRSKFNLGIQ
FTAEAFLSVHELLPMMFYYLLLIKDYSRKESADKVEGIIRKEISNIYAIYDAFANNEINSIADLICRLQK
TNILQGHLPKQMISILEGRQKDMEKEAERKIGEMIDDIQRRLDLLCKQINQKIRIGKRNAGLLKSGKIAD
WLVSDMMRFQPVQKDINNAPINNSKANSTEYRMLQHALALFGSESSRLKAYFRQMNLVGNANPHPFLAET
QWEHQTNILSFYRNYLEARKKYLKGLKPQNWKQYQHFLILKVQKTNRNTLVTGWKNSFNLPRGIFTQPIR
EWFEKHNNSKRIYDQILSFDRVGFVAKAIPLYFAEEYKDNVQPFYDYPFNIGNKLKPQKGQFLDKKERVE
LWQKNKELFKNYPSEKNKTDLAYLDFLSWKKFERELRLIKNQDIVTWLMFKELFKITIVEGLKIGEIHLR
DIDINTANEESNNILNRIMPMKLPVKIYETDNKGNILKERPLATFYIEETETKVLKQGNFKVLAKDRRLN
GLLSFAETTDIDLEKNPITKLSVDYELIKYQTTRISIFEMTLGLEKKLIDKYSTLPTDSFRNMLERWLQC
KANRPELKNYVNSLIAVRNAFSHNQYPMYDATLFAEVKKFTLFPSVDTKKIELNIAPQLLEIVGKAIKEI
EKSENKN \>gi|405580121|gb|EKB54193.1| hypothetical protein HMPREF9699_02005
[*Bergeyella zoohelcum* ATCC 43767] (SEQ ID NO: 49)
MENKTSLGNNIYYNPFKPQDKSYFAGYFNAAMENTDSVFRELGKRLKGKEYISENFFDAIFKENISLVEY
ERYVKLLSDYFPMARLLDKKEVPIKERKENFKKNFKGIIKAVRDLRNFYTHKEHGEVEITDEIFGVLDEM
LKSTVLIVKKKKVKIDKIKEILKKSIEKQLDILCQKKLEYLRDTARKIEEKRRNQRERGEKELVAPFKYS
DKRDDLIAAIYNDAFDVYIDKKKDSLKESSKAKYNIKSDPQQEEGDLKIPISKNGVVFLLSLFLIKQEIH
APFKSKIAGFKATVIDEATVSEATVSHGKNSICFMATHEIFSHLAYKKLKRKVRTAEINYGEAENAEQLSV
YAKETLMMQMLDELSKVPDVVYQNLSEDVQKTFIEDWNEYLKENNGDVGTMEEEQVIHPVIRKRYEDKFN
YFAIRFLDEFAQFPILRFQVHLGNYLHDSRPKENLISDRRIKEKITVFGRLSELEHKKALFIKNTETNED
REHYWEIFPNPNYDFPKENISVNDKDFPIAGSILDREKQPVAGKIGIKVKLLNQQYVSEVDKAVKAHQLK
QRKASKPSIQNIIEEIVPINESNPKEAIVEGGQPTAYLSMNDIHSILYEFFDKWEKKKEKLEKKGEKELR
KEIGKELEKKIVGKIQAQIQQIIDKDINAKILKPYQDGNSTAIDKEKLIKDLKQEQNILQKLKDEQTVRE
KEYNDFIAYQDKNREINKVRDRNHKQYLKDNLKRKYPEAPARKEVLYYREKGKVAVWLANDIKREMPTDF
KNEWKGEQHSLLQKSLAYYEQCKEELKNLLPEKVFQHLPFKLGGYFQQKYLYQFYTCYLDKRLEYISGLV
QQAENFKSENKVFKKVENECFKFLKKQNYTHKELDARVQSILGYPIFLERGFMDEKPTIIKGKIFKGNEA
LFADWFRYYKEYQNFQTFYDTENYPLVELEKKQADRKRKTKIYQQKKNDVFILLMAKHIFKSVFKQDSID
QFSLEDLYQSREERLGNQERARQTGERNTNYIWNKTVDLKLCDGKITVENVKLKNVGDFIKYEYDQRVQA
FLKYEENIEWQAFLIKESKEEENYPYVVEREIEQYEKVRREELLKEVHLIEEYILEKVKDKEILKKGDNQ
NFKYYILNGLLKQLKNEDVESYKVFNLNTEPEDVNINQLKQEATDLEQKAFVLTYIRNKFAHNQLPKKEF
WDYCQEKYGKIEKEKTYAEYFAEVFKKEKEALIK \>gi|408468850|gb|AFU69194.1| hypothetical protein P700755_002426
[*Psychroflexus torquis* ATCC 007555] (SEQ ID NO: 50)
MESIIGLGLSFNPYKTADKHYFGSFLNLVENNLNAVFAEFKERISYKAKDENISSLIEKHFIDNMSIVDY
EKKISILNGYLPIIDFLDDELENNLNTRVKNFKKNFIILAEAIEKLRDYYTHFYHDPITFEDNKEPLLEL
LDEVLLKTILDVKKKYLKTDKIKEILKDSLREEMDLLVIRKTDELREKKKINPKIQHTDSSQLKNSIFND
AFQGLLYEDKGNNKKTQVSHRAKTRLNPKDIHKQEERDFEIPLSTSGLVFLMSLFLSKKEIEDFKSNIKG
FKGKVVKDENHNSLKYMATHRVYSILAFKGLKYRIKTDIFSKETLMMQMIDELSKVPDCVYQNLSETKQK
DFIEDWNEYFKDNEENTENLENSRVVHPVIRKRYEDKFNYFAIRFLDEFANFKILKFQVFMGYYIHDQRT
KTIGTTNITTERTVKEKINVFGKLSKMDNLKKHFFSQLSDDENTDWEFFPNPSYNFLTQADNSPANNIPI
YLELKNQQIIKEKDAIKAEVNQTQNRNPNKPSKRDLLNKILKTYEDFHQGDPTAILSLNEIPALLHLFLV
KPNNKTGQQIENIIRIKIEKQFKAINHPSKNNKGIPKSLFADINVRVNAIKLKKDLEAELDMLNKKHIAF
KENQKASSNYDKLLKEHQFTPKNKRPELRKYVFYKSEKGEEATWLANDIKREMPKDFKIKWKGCQHSELQ
RKLAFYDRHTKQDIKELLSGCEFDHSLLDINAYFQKDNFEDFFSKLYENRIETLEGVLKKLHHKPETP
LKGVFKNCFKFLKRQNYVTESPEIIKKRILAKPTFLPRGVFDERPTMKKGKNPLKDKNEFAEWFVEYLEN
KDYQKFYNAEEYRMRDADFKKNAVIKKQKLKDFYILQMVNYLLKEVFGKDEMNLQLSELFQTRQERLKLQ
GIAKKQMNKETGDSSENTRNQTYIWNKDVPVSFFNGKVTIDKVKLKNIGKYKRYERDERVKIFIGYEVDE
KWMMYLPHNWKDRYSVKPINVIDLQIQEYEEIRSHELLKEIQNLEQYIYDHITDKNILLQDGNPNFKMYV
LNGLLIGIKQVNIPDFIVLKQNINFDKIDFIGIASCSELEKKIIILIAIRNKFAHNQLPNKMIYDLANEF
LKIEKNETYANYYLKVLKKMISDLA \>gi|441484656|gb|AGC41342.1| hypothetical protein G148_2038
[*Riemerella anatipestifer* RA-CH-2] (SEQ ID NO: 51)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFNSLCILNNTDF \>gi|441484658|gb|AGC41344.1| hypothetical protein G148_2040
[*Riemerella anatipestifer* RA-CH-2] (SEQ ID NO: 52)
MFFSFHNAQRVIFKHLYKAFDASLRMVKEDYKAHFIVNLIRDFAHLNRKGKNKQDNPDFNRYRFEKDGFF
TESGLLFFINLFLDKRDAYWMLKKVSGFKASHKQREKMITEVFCRSRILLPKLRLESRYDHNQMLLDMLS
ELSRCPKLLYEKLSEENKKHFQVEADGFLDEIEEEQNPFKDTLIRHQDRFPYFALRYLDLNESFKSIRFQ
VDLGTYHYCIYDKKIGDEQEKRHLTRILLSFGRLQDPFTEINRPQEWKALTKDLDYKETSNQPFISKTIPH
YHITDNKIGFRLGTSKELYPSLEIKDGANRIAKYPYNSGFVAHAFISVHELLPLMFYQHLIGKSEDLLKE
TVRHIQRIYKDFEEERINTIEDLEKANQGRLPLGAFPKQMLGLLQNKQPDLSEKAKIKIEKLIAETKLLS
HRLNIKLKSSPKLGKRREKLIKTGVLADWLVKDFMRFQPVAYDAQNQPIKSSKANSTEFWFIRRALAYG
GEKNRLEGYFKQINLIGNINPHPFLNKFNWKACRNLVDFYQQYLEQREKFLEAIKHQPWEPYQYCLLLKV
PKENRKNLVKGWEQGGISLPRGLFTEAIRETLSKDLILSKPIRKEIKKHGRVGFISRAITLYFKEKYQDK
HQSFYNLSYKLEAKAPLLKKEEHYEYWQQNKPQSPTESQRLEHTSDRWKDYLLYKRWQHLEKKLRLYRN
QDIMLWLMTLELTKNHFKELNLNYHQLKLENLAVNVQEADAKLNPLNQTLPMVLPVKVYPTTAFGEVQYH -continued
```
ETPIRTVYIREEQTKALKMGNFKALVKDRRLNGLFSFIKEENDTQKHPISQLRLRRELEIYQSLRVDAFK
EILSLEEKLLNKHASLSSLENEFRILLEEWKKKYAASSMVIDKHIAFIASVRNAFCHNQYPFYKETLHAP
ILLFTVAQPITEEKDGLGIAEALLKVLREYCEIVKSQI
```

>gi|482527725|gb|E0A10535.1| hypothetical protein A343_1752
[*Porphyromonas gingivalis* JCVI SC001] (SEQ ID NO: 53)
```
MTEQNEKPYNGTYYTLEDKHFWAAFFNLARHNAYITLTHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRC
GNNDNPFFKHHFVDREEKVTEAGLLFFVSLFLEKRDAIWMQKKIRGFKGGTETYQQMTNEVFCRSRISLP
KLKLESLRIDDWMLLDMLNELVRCPKSLYDRLREEDRARFRVPVDILSDEDDIDGTEEDPFKNILVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQLLWPSPEVGATRTGRSKYAQDKRFTAEAFLS
VHELMPMMFYYFLLREKYSEEASAERVQGRIKRVIEDVYAVYDAFARGEIDILDRLDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDRVENHRFLLLKEPKTDRQTLVAGWKGEFHLPRGIFTEAVRDCLIEMGL
DEVGSYKEVGFMAKAVPLYFERACKDRVQPFYDYPFNVGNSLKPKKGRFLSKEKRAEEWESGKERFRDLE
AWSHSAARRIEDAFAGIENASRENKKKIEQLLQDLSLWETFESKLKVKADKINIAKLKKEILEAKEHPYL
DPFKSWQKFERELRLVKNQDIITWMMCRDLMEENKVEGLDIGTLYLKDIRTDVHEQGSLNVLNRVKPMRLP
VVVYRADSRGHVHKEQAPLATVYIEERDTKLLKQGNFKSFVKDRRLNGLFSFVDTGALAMEQYPISKLRV
EYELAKYQTARVCAFEQTLELEESLLTRYPHLPDKNFRKMLESWSDPLLDKWPDLHGNVRLLIAVRNAFS
HNQYPMYDETLFSSIRKYDPSSPDAIEERMGLNIAHRLSEEVKQAKEMVERIIQA
```

>gi|488741127|ref|WP_002664492.1| hypothetical protein [*Bergeyella zoohelcum*] (SEQ ID NO: 54)
```
MENKTSLGNNIYYNPFKPQDKSYFAGYFNAAMENTDSVFRELGKRLKGKEYISENFFDAIFKENISLVEY
ERYVKLLSDYFPMARLLDKKEVPIKERKENPKKNFKGIIKAVRDLRNFYTHKEHGEVEITDEIFGVLDEM
LKSTVLIVKKKKVKIDKIKEILKKSIEKQLDILCQKKLEYLRDTARKIEEKRRNQRERGEKELVAPFKYS
DKRDDLIAAIYNDAFDVYIDKKKDSLKESSKAKYNIKSDPQQEGDLKIPISKNGVVFLLSLFLKQEIH
AFKSKIAGFKATVIDEATVSEATVSHGKNSICFMATHEIFSHLAYKKLRKVRTAEINYGEAENAEQLSV
YAKETLMMQMLDELSKVPDVVYQNLSEDVQKTFIEDWNEYLKENNGDVGTMEEEQVIHPVIRKRYEDKFN
YFAIRFLDEFAQFPILRFQVHLGNYLHDSRPKENLISDRRIKEKITVFGRLSELEHKKALFIKNTETNED
REHYWEIFPNPNYDFPKENISVNDKDFPIAGSILDREKQPVAGKIGIKVKLLNQQYVSEVDKAVKAHQLK
QRKASKPSIQNIIEEIVPINESNPKEAIVEGGQPTAYLSMNDIHSILYEFFDKWEKKKEKLEKKGEKELR
KEIGKELEKKIVGKIQAQIQQIIDKDINAKILKPYQDGNSTAIDKEKLIKDLKQEQNILQKLKDEQTVRE
KEYNDFIAYQDKNREINKVRDRNHKQYLKDNLKRKYPEAPARKEVLYYREKGKVAVWLANDIKREMPTDF
KNEWKGEQHSLLQKSLAYYEQCKEELKNLLPEKVFQHLPFKLGGYFQQKYLYQFYTCYLDKRLEYISGLV
QQAENFKSENKVFKKVENECFKFLKKQNYTHKELDARVQSILGYPIFLERGFMDEKPTIIKGKIFKGNEA
LFADWFRYYKEYQNFQTFTFYDTENYPLVELEKKQADRKRKTKIYQQKKNDVFILLMAKHIFKSVFKQDSID
QFSLEDLYQSREERLGNQERARQTGERNTNYIWNKTVDLKLCDGKITVENVKLKNVGDFIKYEYDQRVQA
FLKYEENIEWQAFLIKESKEEENYPYVVEREIEQYEKVRREELLKEVHLIEEYILEKVKDKEILKKGDNQ
NFKYYILNGLLKQLKNEDVESYKVFNLNTEPEDVNINQLKQEATDLEQKAFVLTYIRNKFAHNQLPKKEF
WDYCQEKYGKIEKEKTYAEYFAEVFKKEKEALIK
```

>gi|490473137|ref|WP_004343581.1| hypothetical protein [*Prevotella buccae*] (SEQ ID NO: 55)
```
MQKQDKLFVDRKKNAIFAFPKYITIMENQEKPEPIYYELTDKHFWAAFLNLARHNVYTTINHINRRLEIA
ELKDDGYMMDIKGSWNEQAKKLDKKVRLRDLIMKHFPFLEAAAYEITNSKSPNNKEQREKEQSEALSLNN
LKNVLFIFLEKLQVLRNYYSHYKYSEESPKPIFETSLLKNMYKVFDANVRLVKRDYMHHENIDMQRDFTH
LNRKKQVGRIKNIIDSPNFHYHFADKEGNMTIAGLLFFVSLFLDKKDAIWMQKKLKGFKDGRNLREQMIN
EVFCRSRISLPKLKLENVQTKDWMQLDMLNELVRCPKSLYERLREKDRESFKVPFDIFSDDYDAEEEPFK
NTLVRHQDRFPYFVLRYFDLNEIFEQLRFQIDLGTYHFSIYNKRIGDEDEVRHLTHHLYGFARIQDFPAQQ
NQPEVWRKLVKDLDYFEASQEPYIPKTAPHYHLENEKIGIKFCSIHNNLFPSLKTEKTCNGRSKFNLGIQ
FTAEAFLSVHELLPMMFYYLLIKDYSRKESADKVEGIIRKEISNIYAIYDAFANGEINSIADLICRLQK
TNILQGHLPKQMISILEGRQKDMEKEAERKIGEMIDDIQRRLDLLCKQINQKIRIGKRNAGLLKSGKIAD
WLVNDMMRFQPVQKDQNNIPINNSKANSTEYRMLQRALALFGSENFRLKAYFNQMNLVGNDNPHPFLAET
QWEHQTNILSFYRNYLEARKKYLKGLKPQNWKQYQHFLILKVQKTNRNTLVTGWKNSFNLPRGIFTQPIR
EWFEKHNNSKRIYDQILSFDRVGFVAKAIPLYFAEEYKDNVQPFYDYPFNIGNKLKPQKGQFLDKKERVE
LWQKNKELFKNYPSEKKKIDLAYLDFLSWKKFERELRLIKNQDIVTWLMFKELFNMATVEGLKIGEIHLR
DIDINTANEESNNILNRIMPMKLPVKIYETDNKGNILKERPLATFYIEETETKVLKQGNFKVLAKDRRLN
GLLSFAETTDIDLEKNPITKLSVDHELIKYQTTRISIFEMTLGLEKKLINKYPTLPTDSFRNMLERWLQC
KANRPELKNYVNSLIAVRNAFSHNQYPMYDATLFAEVKKFTLFPSVDTKKIELNIAPQLLEIVGKAIKEI
EKSENKN
```

>gi|490473535|ref|WP_004343973.1| hypothetical protein [*Prevotella buccae*] (SEQ ID NO: 56)
```
MQKQDKLFVDRKKNAIFAFPKYITIMENKEKPEPIYYELTDKHFWAAFLNLARHNVYTTINHINRRLEIA
ELKDDGYMMGIKGSWNEQAKKLDKKVRLRDLIMKHFPFLEAAAYEMINSKSPNNKEQREKEQSEALSLNN
LKNVLFIFLEKLQVLRNYYSHYKYSEESPKPIFETSLLKNMYKVFDANVRLVKRDYMHHENIDMQRDFTH
LNRKKQVGRIKNIIDSPNFHYHFADKEGNMTIAGLLFFVSLFLDKKDAIWMQKKLKGFKDGRNLREQMIN
EVFCRSRISLPKLKLENVQTKDWMQLDMLNELVRCPKSLYERLREKDRESFKVPFDIFSDDYNAEEEPFK
NTLVRHQDRFPYFVLRYFDLNEIFEQLRFQIDLGTYHFSIYNKRIGDEDEVRHLTHHLYGFARIQDFAPQ
NQPEEWRKLVKDLDHFETSQEPYISKTAPHYHLENEKIGIKFCSAHNNLFPSLQTDKICKGRSKFNLGIQ
FTAEAFLSVHELLPMMFYYLLLIKDYSRKESADKVEGIIRKEISNIYAIYDAFANNEINSIADLTRRLQN
TNILQGHLPKQMISILKGRQKDMGKEAERKIGEMIDDIQRRLDLLCKQINQKIRIGKRNAGLLKSGKIAD
WLVNDMMRFQPVQKDQNNIPINNSKANSTEYRMLQRALALFGSENFRLKAYFNQMNLVGNDNPHPFLAET
QWEHQTNILSFYRNYLEARKKYLKGLKPQNWKQYQHFLILKVQKTNRNTLVTGWKNSFNLPRGIFTQPIR
EWFEKHNNSKRIYDQILSFDRVGFVAKAIPLYFAEEYKDNVQPFYDYPFNIGNRLKPKKRQFLDKKERVE
LWQKNKELFKNYPSEKKKIDLAYLDFLSWKKFERELRLIKNQDIVTWLMFKELFNMATVEGLKIGEIHLR
DIDINTANEESNNILNRIMPMKLPVKIYETDNKGNILKERPLATFYIEETETKVLKQGNFKALVKDRRLN
```

```
-continued
GLFSFAETTDLNLEEHPISKLSVDLELIKYQTTRISIFEMTLGLEKKLIDKYSTLPTDSFRNMLERWLQC
KANRPELKNYVNSLIAVRNAFSHNQYPMYDATLFAEVKKFTLFPSVDTKKIELNIAPQLLEIVGKAIKEI
EKSENKN
```

>gi|491058119|ref|WP_004919755.1| hypothetical protein [*Riemerella anatipestifer*] (SEQ ID NO: 57)
```
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFKHLYKAFDASLRMVKEDYKAHFIVNLIRDFAHLNRKGKNKQDNPDFNRYR
FEKDGFFTESGLLFFINLFLDKRDAYWMLKKVSGFKASHKQREKMITEVFCRSRILLPKLRLESRYDHNQ
MLLDMLSELSRCPKLLYEKLSEENKKHFQVEADGFLDEIEEEQNPFKDTLIRHQDRFPYFALRYLDLNES
FKSIRFQVDLGTYHYCIYDKKIGDEQEKRHLTRILLSFGRLQDFTEINRPQEWKALTKDLDYKETSNQPF
ISKTIPHYHITDNKIGFRLGTSKELYPSLEIKDGANRIAKYPYNSGFVAHAFISVHELLPLMFYQHLIGK
SEDLLKETVRHIQRIYKDFEEERINTIEDLEKANQGRLPLGAFPKQMLGLLQNKQPDLSEKAKIKIEKLI
AETKLLSHRLNIKLKSSPKLGKRREKLIKTGVLADWLVKDFMRFQPVAYDAQNQPIKSSKANSTEFWFIR
RALALYGGEKNRLEGYFKQINLIGNINPHPFLNKFNWKACRNLVDFYQQYLEQREKFLEAIKNQPWEPYQ
YCLLLKIPKENRKNLVKGWEQGGISLPRGLFTEAIRETLSEDLMLSKPIRKEIKKHGRVGFISRAITLYF
KEKYQDKHQSFYNLSYKLEAKAPLLKREEHYEYWQQNKPQSPTESQRLELHTSDRWKDYLLYKRWQHLEK
KLRLYRNQDVMLWLMTLELTKNHFKELNLNYHQLKLENLAVNVQEADAKLNPLNQTLPMVLPVKVYPATA
FGEVQYHKTPIRTVYIREEHTKALKMGNFKALVKDRRLNGLFSFIKEENDTQKHPISQLRLRRELEIYQS
LRVDAFKETLSLEEKLLNKHISLSSLENEFRALLEEWKKEYAASSMVIDEHIAFIASVRNAFCHNQYPFY
KEALHAPIPLFTVAQPITEEKDGLGIAEALLKVLREYCEIVKSQI
```

>gi|492521417|ref|WP_005873511.1| hypothetical protein [*Porphyromonas gingivalis*] (SEQ ID NO: 58)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHNLRKLLLMELLCEGSFSRMQSDFLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL
```

>gi|492916530|ref|WP_006044833.1| hypothetical protein [*Prevotella pallens*] (SEQ ID NO: 59)
```
MKEEEKGKTPVVSTYNKDDKHFWAAFLNLARHNVYITVNHINKILGEGEINRDGYENTLEKSWNEIKDIN
KKDRLSKLIIKHFPFLEVITYQRNSADTTKQKEEKQAEAQSLESLKKSFFVFIYKLRDLRNHYSHYKHSK
SLERPKFEEDLQEKMYNIFDASIQLVKEDYKHNTDIKTEEDFKHLDRKGQFKYSFADNEGNITESGLLFF
VSLFLEKKDAIWVQKKLEGFKCSNESYQKMTNEVFCRSRMLLPKLRLQSTQTQDWILLDMLNELIRCPKS
LYERLREEDRKKFRVPIEIADEDYDAEQEPFKNALVRHQDRFPYFALRYFDYNEIFTNLRFQIDLGTYHF
SIYKKQIGDYKESHHLTHKLYGFERIQEFTKQNRPDEWRKFVKIFNSFETSKEPYITPETTPHYHLENQKI
GIRFRNDNDKIWPSLKINSEKNEKSKYKLDKSFQAEAFLSVHELLPMMFYLLLLKTENTDNDNEIETKKK
ENKNDKQEKHKIEEIIENKITEIYALYDAFANGKINSIDKLEEYCKGKDIEIGHLPKQMIAILKSEHKDM
ATEAKRKQEEMLADVQKSLESLDNQINEEIENVERKNSSLKSGEIASWLVNDMMRFQPVQKDNEGNPLNN
SKANSTEYQMLQRSLALYNKEEKPTRYFRQVNLIESSNPHPFLNNTEWEKCNNILSFYRSYLEAKKNFLE
SLKPEDWEKNQYFLMLKEPKINCETLVQGWKNGFNLPRGIFTEPIRKWFMEHRKNITVAELKRVGLVAKV
IPLFFSEEYKDSVQPFYNYLFNVGNINKPDEKNFLNCEERRELLRKKKDEFKKMTDKEKEENPSYLEFQS
WNKFERELRLVRNQDIVTWLLCMELFNKKKIKELNVEKIYLKNININTIKKEKNTEEKNGEEKIIKEKNN
ILNRIMPMRLPIKVYGRENFSKNKKKKIRRNIFFTVYIEEKGTKLLKQGNFKALERDRRLGGLFSFVKTH
SKAESKSNTISKSRVEYELGEYQKARIEIIKDMLALEETLIDKYNSLDIDNFHNMLIGWLKLKDEPDKAS
FQNDVDLLIAVRNAFSHNQYPMRNRIAFANINPFSLSSANTSEEKGLGIANQLKDKIHKTIEKIIEIEKP
IETKE
```

>gi|493302367|ref|WP_006259957.1| hypothetical protein [*Myroides odoratimimus*] (SEQ ID NO: 60)
```
MKDILTIDTTEKQNRFYSHKIADKYFFGGYFNLASNNIYEVFEEVNKRNIFGKLAKRDNGNLKNYIIHVF
KDELSISDFEKRVAIFASYFPILETVDKKSIKERNRTIDLILSQRIRQFREMLISLVTAVDQLRNFYTHY
HHSDIVIENKVLDFLNSSFVSTALHVKDKYLKTDKIKEFLKETIAAELDILIEAYKKKQIEKKNTRFKAN
KREDILNAIYNEAFWSPINDKDKDKDKETVVAKGADAYFEKNHHKSNDPDFALNISEKGIVYLLSPFLIN
KEMDSLKANLIGFKGKVDRESGNSIKYMATQRIYSFHTYRGLKQKIRTSEEGVKEILLMQMIDELSKVPN
VVYQHLSTIQQNSFIEDWNEYYKDYEDDVETDDLSRVIHPVIRKRYEDRFNYFAIRFLDEFFDFPILRFQ
VHLGDYVHDRRIKQLGKVESDRIIKEKVIVFARLKDINSAKASYFHSLEEQDKEELDNKWILFPNPSYDF
PKEHTLQHQGEQKNAGKIGIYVKLRDTQYKEKAALEEARKSLNPKERSATKASKYDIITQIIEANDNVKS
EKPLVFIGQPIAYLSMNDIHSMLFSLLIDNAELKKTPEEVEAKLLDQIGKQINEILSKDIDTKILKKYKD
NDLKETDIDKITRDLARDKEEIEKLILEQKQRADDYNYISSTKFNIDKSRKRKHLLFNAEKGKIGVWLAN
DIKRFMFKESKSKWKGYQHTELQKLFAYFDTSKSDLELILSNMVMVKDYPIELIDLVKKSRILVDFLNKY
LEARLEYIENVITRVKNSIGTPQFKIVRKECFTFLKKSNYTVVSLDKQVERILSMPLFIERGFMDDKPIM
LEGKSYKQHKEKFADWFVHYKENSNYQNFYDIEVYEITTEDKREKAKVIKKIKQQQKNDVFILMMVNYML
EEVLKLSSNDRLSLNELYQTKEERIVNKQVAKDTQERNKNYIWNKVVDLQLCDGLVHIDNVKLKDIGNFR
KYENDSRVKEFLTYQSDIVWSAYLSNEVDSNKLYVIERQLDNYESIRSKELLKEVQEIECSVYNQVANKE
```

```
SLKQSGNENFKQYVLQGLLPIGMDVREMLILSTDVKFKKEEIIQLGQAGEVEQDLYSLIYIRNKFAHNQL
PIKEFFDFCENNYRSISDNEYYAEYYMEIFRSIKEKYAN
```

>gi|494654219|ref|WP_007412163.1| hypothetical protein [*Prevotella* sp. MSX73] (SEQ ID NO: 61)
```
MQKQDKLFVDRKKNAIFAFPKYITIMENQEKPEPIYYELTDKHFWAAFLNLARHNVYTTINHINRRLEIA
ELKDDGYMMGIKGSWNEQAKKLDKKVRLRDLIMKHFPFLEAAAYEITNSKSPNNKEQREKEQSEALSLNN
LKNVLFIFLEKLQVLRNYYSHYKYSEESPKPIFETSLLKNMYKVFDANVRLVKRDYMHHENIDMQRDFTH
LNRKKQVGRIKNIIDSPNFHYHFADKEGNMTIAGLLFFVSLFLDKKDAIWMQKKLKGFKDGRNLREQMIN
EVFCRSRISLPKLKLENVQTKDWMQLDMLNELVRCPKSLYERLREKDRESFKVPFDIFSDDYDAEEEPFK
NTLVRHQDRFPYFVLRYFDLNEIFEQLRFQIDLGTYHFSIYNKRIGDEDEVRHLTHHLYGFARIQDFAPQ
NQPEEWRKLVKDLDHFETSQEPYISKTAPHYHLENEKIGIKFCSIHNNLFPSLKREKTCNGRSKFNLGIQ
FTAEAFLSVHELLPMMFYYLLLIKDYSRKESADKVEGIIRKEISNIYAIYDAFANNEINSIADLICRLQK
TNILQGHLPKQMISILEGRQKDMEKEAERKIGEMIDDIQRRLDLLCKQINQKIRIGKRNAGLLKSGKIAD
WLVSDMMRFQPVQKDINNAPINNSKANSTEYRMLQHALALFGSESSRLKAYFRQMNLVGNANPHPFLAET
QWEHQTNILSFYRNYLEARKKYLKGLKPQNWKQYQHFLILKVQKTNRNTLVTGWKNSFNLPRGIFTQPIR
EWFEKHNNSKRIYDQILSFDRVGFVAKAIPLYFAEEYKDNVQPFYDYPFNIGNKLKPQKGQFLDKKERVE
LWQKNKELFKNYPSEKNKTDLAYLDFLSWKKFERELRLIKNQDIVTWLMFKELFKITIVEGLKIGEIHLR
DIDINTANEESNNILNRIMPMKLPVKIYETDNKGNILKERPLATFYIEETETKVLKQGNFKVLAKDRRLN
GLLSFAETTDIDLEKNPITKLSVDYELIKYQTTRISIFEMTLGLEKKLIDKYSTLPTDSFRNMLERWLQC
KANRPELKNYVNSLIAVRNAFSHNQYPMYDATLFAEVKKFTLFPSVDTKKIELNIAPQLLEIVGKAIKEI
EKSENKN
```

>gi|501433495|ref|WP_012458151.1| hypothetical protein [*Porphyromonas gingivalis*] (SEQ ID NO: 62)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFAVPFKPDDFVLAKNRKEQLISVADGKECLIVSGFAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLDEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSDPFLRKANRILDETAE
GKLQFSALFPEMRHRFIPPQNPKSKDRREKAETTLEKYKQEIKGRKDKLNSQLLSAFDMDQRQLPSRLLD
EWMNIRPASHSVKLRTYVKQLNEDCRLRLRKFRKDGDGKARAIFLVPGEMATFLSQDIVRMIISEETKKLI
TSAYYNEMQRSLAQYAGEENRRQFRAIVAELRLLDPSSGHPFLSATMETAHRYTEGFYKCYLEKKREWLA
KIFYRPEQDENTKRRISVFFVPDGEARKLLPLLIRRRMKEQNDLQDWIRNKQAHPIDLPSHLFDSKVMEL
LKVKDGKKKWNEAFKDWWSTKYPDGMQPFYGLRRELNIHGKSVSYIPSDGKKFADCYTHLMEKTVRDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILLDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL
```

>gi|501433759|ref|WP_012458414.1| hypothetical protein [*Porphyromonas gingivalis*] (SEQ ID NO: 63)
```
MTEQNERPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREEKVTEAGLLFFVSLFLEKRDAIWMQKKIRGFKGGTETYQQMTNEVFCRSRISLP
KLKLESLRIDDWMLLDMLNELVRCPKSLYDRLREEDRARFRVPVDILSDEDDIDGTEEDPFKNILVRHQD
RPFYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRLTAEAFLS
VHELMPMMFYYFLLREKYSDEASAERVQGRIKRVIEDVYAVYDAFARGEINTRDELDACLADKGIRRGHL
PRQMIGILSQEHKDMEEKVRKKLQEMIVDTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDRVENHRFLLLKEPKTDRQTLVAGWKGEFHLPRGIFTEAVRDCLIEMGL
DEVGSYKEVGFMAKAVPLYFERACKDRVQPFYDYPFNVGNSLKPKKGRFLSKEKRAEEWESGKERFRLAK
LKKEILEAKEHPYLDFKSWQKFERELRLVKNQDIITWMICRDLMEENKVEGLDIGTLYLKDIRTDVQEQG
NLNVLNRVKPMRLPVVVYRADSRGHVHKEQAPLATVYIEERDTKLLLKQGNFKSFVKDRRLNGLFSFVDTG
ALAMEQYPISKLRVEYELAKYQTARVCAFEQTLELEESLLTRYPHLPDKNFRKMLESWSDPLLDKWPDLH
GNVRLLIAVRNAFSHNQYPMYDEAVFSSIRKYDPSSPDAIEERMGLNIAHRLSEEVKQAKEMAERIIQA
```

>gi|503582079|ref|WP_013816155.1| hypothetical protein [*Porphyromonas gingivalis*] (SEQ ID NO: 64)
```
MTEQNEKPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKNELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREGIVTEAGLLFFVSLFLEKRDAIWMQKKIRGFKGGTETYQQMTNEVFCRSRISLP
KLKLESLRIDDWMLLDMLNELVRCPKSLYDRLREEDRARFRVPVDILSDEEDIDGAEEDPFKNILVRHQD
RPFYFALRYFDLKKVFTSLRFQIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRFTAEAFLS
AHELMPMMFYYFLLREKYSEEASAERVQGRIKRVIEDVYAVYDAFARDEINTRDELDACLADKGIRRGHL
PRQMIGILSQEHKDMEEKIRKKLQEMMADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDRVENHRFLLLKEPKTDRQTLVAGWKGEFHLPRGIFTEAVRDCLIEMGL
DEVGSYKEVGFMAKAVPLYFERACKDWVQPFYNYPFNVGNSLKPKKGRFLSKEKRAEEWESGKERFRLAK
LKKEILEAKEHPYLDFKSWQKFERELRLVKNQDIITWMICGDLMEENKVEGLDIGTLYLKDIRTDVQEQG
SLNVLNRVKPMRLPVVVYRADSRGHVHKEQAPLATVYIEERDTKLLKQGNFKSFVKDRRLNGLFSFVDTG
ALAMEQYPISKLRVEYELAKYQTARVCAFEQTLELEESLLTRCPHLPDKNFRKMLESWSDPLLDKWPDLH
RKVRLLIAVRNAFSHNQYPMYDEAVFSSIRKYDPSFPDAIEERMGLNIAHRLSEEVKQAKETVERIIQA
```

>gi|503763195|ref|WP_013997271.1| hypothetical protein [*Capnocytophaga canimorsus*] (SEQ ID NO: 65)
MKNIQRLGKGNEFSPFKKEDKFYFGGFLNLANNNIEDFFKEIITREGIVITDENKKPKETFGEKILNEIF
KKDISIVDYEKWVNIFADYFPFTKYLSLYEEMQFKNRVICFRDVMKELLKTVEALRNFYTHYDHEPIKI
EDRVFYFLDKVLLDVSLIVKNKYLKTDKIKEFLNQHIGEELKELCKQRKDYLVGKGKRIDKESEIINGIY
NNAFKDFICKREKQDDKENHNSVEKILCNKEPQNKKQKSSATVWELCSKSSSKYTEKSFPNRENDKHCLE
VPISQKGIVFLLSFFLNKGEIYALTSNIKGFKAKITKEEPVTYDKNSIRYMATHRMFSFLAYKGLKRKIR
TSEINYNEDGQASSTYEKETLMLQMLDELNKVPDVVYQNLSEDVQKTFIEDWNEYLKENNGDVGTMEEEQ
VIHPVIRKRYEDKFNYFAIRFLDEFAQFPILRFQVHLGNYLCDKRTKQICDTTTEREVKKKITVFGRLSE
LENKKAIFLNEREEIKGWEVFPNPSYDFPKENISVNYKDFPIVGSILDREKQPVSNKIGIRVKIADELQR
EIDKAIKEKKLRNPKNRKANQDEKQKERLVNEIVSINSNEQGEPVVFIGQPTAYLSMNDIHSVLYEFLIN
KISGEALETKIVEKIETQIKQIIGKDATTKILKPYTNANSNSINREKLLRDLEQEQQILKILLEEQQQRE
KDKKDKKSKRKHELYPSEKGKVAVWLANDIKREMPKAFKEQWRGYHHSLLQKYLAYYEQSKEELKNLLPK
EVFKHFPFKLKGYFQQQYLNQFYIDYLKRRLSYVNELLLNIQNFKNDKDALKATEKECFKFFRKQNYIIN
PINIQIQSILVYPIFLKRGFLDEKPIMIDREKFKENKDTELADWFMHYKNYKEDNYQKFYAYPLEKVEEK
EKFKRNKQINKQKKNDVYTLMMVEYIIQKIFGDKFVEENPLVLKGIFQSKAERQQNNTHAATTQERNLNG
ILNQPKDIKIQGKITVKGVKLKDIGNFRKYEIDQRVNTFLDYEPRKEWMAYLPNDWKEKEKQGQLPPNNV
IDRQISKYETVRSKILLKDVQELEKIISDEIKEEHRHDLKQGKYYNFKYYILNGLLRQLKNENVENYKVF
KLNINPEKVNITQLKQEATDLEQKAFVLTYIRNKFAHNQLPKKEFWDYCQEKYGKIEKEKTYAEYFAEVF
KREKEALIK >gi|503931547|ref|WP_014165541.1| hypothetical protein [*Flavobacterium columnare*] (SEQ ID NO: 66)
MSSKNESYNKQKTFNHYKQEDKYFFGGFLNNADDNLRQVGKEFKTRINFNHNNNELASVFKDYFNKEKSV
AKREHALNLLSNYFPVLERIQKHINHNFEQTREIFELLLDTIKKLRDYYTHHYHKPITINPKIYDFLDDT
LLDVLITIKKKKVKNDTSRELLKEKLRPELTQLKNQKREELIKKQKLLEENLENAVFNHCLRPFLEENK
TDDKQNKTVSLRKYRKSKPNEETSITLIQSGLVFLMSFFLHRKEFQVFTSGLEGFKAKVNTIKEEEISLN
KNNIVYMITHWSYSYYNFKGLKHRIKTDQGVSTLEQNNITHSLINTNIKEALLTQIVDYLSKVPNEIYET
LSEKQQKEFEEDINEYMRENPENEDSTFSSIVSHKVIRKRYENKFNYFAMRFLDEYAELPTLRFMVNFGD
YIKDRQKKILESIQFDSERIIKKEIHLFEKLSLVTEYKKNVYLKETSNIDLSRFPLFPNPSYVMANNNIP
FYIDSRSNNLDEYLNQKKKAQSQNKKRNLIFEKYNKEQSKDAIIAMLQKEIGVKDLQQRSTIGLLSCNEL
PSMLYEVIVKDIKGAELENKIAQKIREQYQSIRDFILDSPQKDNIPTTLIKTINTDSSVIFENQPIDIPR
LKNAIQKELTLIQEKLLNVKEHEIEVDNYNRNKNTYKFKNQPKNKVDDKKLQRKYVFYRNEIRQEANWLA
SDLIHFMKNKSLWKGYMHNELQSFLAFFEDKKNDCIALLETVFNLKEDCILTKGLKNLFLKHGNFIDFYK
EYLKLKEDFLNTESTFLENGLIGLPPKILKKELSKRFKYIFIVFQKRQFIIKELEEKKNNLYADAINLSR
GIFDEKPIMIPFKKPNPDEFASWFVASYQYNNYQSFYELTPDIVERDKKKKYKNLRAINKVKIQDYYLKL
MVDTLYQDLFNQPLDKSLSDFYVSKAEREKIKADAKAYQKRNDSSLWNKVIHLSLQNNRITANPKLKDIG
KYKRALQDEKIAILLTYDDRIWTYALQKPEKENENDYKELHYTALNMELQEYEKVRSKELLKQVQELEKQ
ILEEYTDFLSTQIHPADFERENGNPNFKKYLAHSILENEDDLDKLPEKVEAMRELDETITNPIIKKAIVLI
IIRNKMAHNQYPPKFIYDLANRFVPKKEEEYFATYFNRVFETITKELWENKEKKDKTQV >gi|504837663|ref|WP_015024765.1| hypothetical protein [*Psychroflexus torquis*] (SEQ ID NO: 67)
MESIIGLGLSFNPYKTADKHYFGSFLNLVENNLNAVFAEFKERISYKAKDENISSLIEKHFIDNMSIVDY
EKKISILNGYLPIIDFLDDELENNLNTRVKNFKKNFIILAEAIEKLRDYYTHFYHDPITFEDNKEPLLEL
LDEVLLKTILDVKKKYLKTDKIKEILKDSLREEMDLLVIRKTDELREKKKINPKIQHTDSSQIKNSIFND
APQGLLYEDKGNNKKTQVSHRAKTRLNPKDIHKQEERDFEIPLSTSGLVFLMSLFLSKKEIEDFKSNIKG
FKGKVVKEDENHNSLKYMATHRVYSILAFKGLKYRIKTDIFSKETLMMQMIDELSKVPDCVYQNLSETKQK
DFIEDWNEYFKDNEENTENLENSRVVHPVIRKRYEDKFNYFAIRFLDEFANFKILKFQVFMGYYIHDQRT
KTIGTTNITTERTVKEKINVFGKLSKMDNLKKHFFSQLSDDENTDWEFFPNPSYNFLTQADNSPANNIPI
YLELKNQQIIKEKDAIKAEVNQTQNRNPNKPSKRDLLNKILKTYEDFHQGDPTAILSLNEIPALLHLFLV
KPNNKTGQQIENIIRIKIEKQFKAINHPSKNNKGIPKSLFADINVRVNAIKLKKDLEAELDMLNKKHIAF
KENQKASSNYDKLLKEHQFTPKNKRPELRKYVFYKSEKGEEATWLANDIKREMPKDFKIKWKGCQHSELQ
RKLAFYDRHTKQDIKELLSGCEFDHSLLDINAYFQKDNFEDFFSKYLENRIETLEGVLKKLHDFKNEPTP
LKGVFKNCFKFLKRQNYVTESPEIIKKKRILAKPTFLPRGVFDERPTMKKGKNPLKDKNEFAEWFVEYLEN
KDYQKFYNAEEYRMRDADFKKNAVIKKQKLKDFYILQMVNYLLKEVFGKDEMNLQLSELFQTRQERLKLQ
GIAKKQMNKETGDSSENTRNQTYIWNKDVPVSFFNGKVTIDKVKLKNIGKYKRYERDERVKIFIGYEVDE
KWMMYLPHNWKDRYSVKPINVIDLQIQEYEEIRSHELLKEIQNLEQYIYDHITDKNILLQDGNPNFKMYV
LNGLLIGIKQVNIPDFIVLKQNINFDKIDFIGIASCSELEKKIIILIAIRNKFAHNQLPNKMIYDLANEF
LKIEKNETYANYYLKVLKKMISDLA >gi|505158517|ref|WP_015345619.1| hypothetical protein [*Riemerella anatipestifer*] (SEQ ID NO: 68)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFNSLCILNNTDF >gi|505158518|ref|WP_015345620.1| hypothetical protein [*Riemerella anatipestifer*] (SEQ ID NO: 69)
MFFSFHNAQRVIFKHLYKAFDASLRMVKEDYKAHFIVNLIRDFAHLNRKGKNKQDNPDFNRYRFEKDGFF
TESGLLFFINLFLDKRDAYWMLKKVSGFKASHKQREKMITEVFCRSRILLPKLRLESRYDHNQMLLDMLS
ELSRCPKLLYEKLSEENKKHFQVEADGFLDEIEEEQNPFKDTLIRHQDRFPYFALRYLDLNESFKSIRFQ
VDLGTYHYCIYDKKIGDEQEKRHLTRILLSFGRLQDFTEINRPQEWKALTKDLDYKETSNQPFISKTIPH
YHITDNKIGFRLGTSKELYPSLEIKDGANRIAKYPYNSGFVAHAFISVHELLPLMFYQHLIGKSEDLLKE
TVRHIQRIYKDFEEERINTIEDLEKANQGRLPLGAFPKQMLGLLQNKQPDLSEKAKIKIEKLIAETKLLS
HRLNIKLKSSPKLGKRREKLIKTGVLADWLVKDFMRFQPVAYDAQNQPIKSSKANSTEWFIRRALALYG
GEKNRLEGYFKQINLIGNINPHPFLNKFNWKACRNLVDFYQQYLEQREKFLEAIKHQPWEPYQYCLLLKV
PKENRKNLVKGWEQGGISLPRGLFTEAIRETLSKDLILSKPIRKEIKKHGRVGFISRAITLYFKEKYQDK
HQSFYNLSYKLEAKAPLLKKEEHYEYWQQNKPQSPTESQRLELHTSDRWKDYLLYKRWQHLEKKLRLYRN
QDIMLWLMTLELTKNHFKELNLNYHQLKLENLAVNVQEADAKLNPLNQTLPMVLPVKVYPTTAFGEVQYH
ETPIRTVYIREEQTKALKMGNFKALVKDRRLNGLFSFIKEENDTQKHPISQLRLRRELEIYQSLRVDAFK

```
EILSLEEKLLNKHASLSSLENEFRILLEEWKKKYAASSMVIDKHIAFIASVRNAFCHNQYPFYKETLHAP
ILLFTVAQPITEEKDGLGIAEALLKVLREYCEIVKSQI

>gi|543953686|gb|ERJ64231.1| hypothetical protein HMPREF1555_01956
[Porphyromonas gingivalis F0570] (SEQ ID NO: 70)
MRDLDYFETGDKPYITQTTPHYHIEKGKIGLRFVPEGQHLWPSPEVGATRTGRSKYAQDKRLTAEAFLSV
HELMPMMFYYFLLREKYSDEASAERVQGRIKRVIEDVYAVYDAFARGEIDILDRLDACLADKGIRRGHLP
RQMIAILSQEHKDMEEKVRKKLQEMIADTDHRLDMLDRQTDRKIRIGRKNAGLPKSGVIADWLVRDMMRF
QPVAKDTSGKPLNNSKANSTEYRMLQRALALFGGEKERLIPYFRQMNLIGGNNPHPFLHETRWESHINIL
SFYRSYLKARKAFLQSIGRSDRVENHRFLLLKEPKTDRQTLVAGWKSEFHLPRGIFTEAVRDCLIEMGHD
EVGSYKEVGFMAKAVPLYFERACKDRVQPFYDYPFNVGNSLKPKKGRFLSKEDRAEEWESGKERFRLAKL
KKEILEAKEHPYLDFKSWQKFERELRLVKNQDIITWMMCRDLMEENKVEGLDIGTLYLKDIRTDVYEQGS
LNVLNRVKPMRLPVVVYRADSRGHVHKEQAPLATVYIEERDTKLLKQGNFKSFVKDRRLNGLFSFVDTGG
LAMEQYPISKLRVEYELAKYQTARVCAFEQTLELEESLLTRYPHLPDESFREMLESWSDPLLDKWPDLHR
KVRLLIAVRNAFSHNQYPMYDEAVFSSIRKYDPSSPDAIEERMGLNIAHRLSEEVKQAKEMAERIIQA >gi|543955272|gb|ERJ65637.1| hypothetical protein HMPREF1553_02065
[Porphyromonas gingivalis F0568] (SEQ ID NO: 71)
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPRSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAPFDMDQRQLPSRLLD
EWMNIRPASHSVKLRTYVKQLNEDCRLRLQKFRKDGDGKARAIPLVGEMATFLSQDIVRMIISEETKKLI
TSAYYNEMQRSLAQYAGEENRHQFRAIVAELRLLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL >gi|543955721|gb|ERJ66054.1| hypothetical protein HMPREF1553_01900
[Porphyromonas gingivalis F0568] (SEQ ID NO: 72)
MRDLDCFETGDKPYITQTTPHYHIEKGKIGLRFVPEGQHLWPSPEVGATRTGRSKYAQDKRLTAEAFLSV
HELMPMMFYYFLLREKYSDEASAERVQGRIKRVIEDVYAVYDAFARGEIDILDRLDACLADKGIRRGHLP
RQIIAILSQEHKDMEEKVRKKLQEMIADTDHRLDMLDRQTDRKIRIDRKNAGLPKSGVIADWLVRDMMRF
QPVAKDTSGKPLNNSKANSTEYRMLQRALALFGGEKERLIPYFRQMNLIGGNNPHPFLHETRWESHINIL
SFYRSYLKARKAFLQSIGRSDRVENHRFLLLKEPKTDRQTLVAGWKSEFHLPRGIFTEAVRDCLIEMGLD
EVGSYKEVGFMAKAVPLYFERACKDRVQPFYNYPFNVGNILKPKKGRFLSKEKRAEEWESGKERFRDLEA
WSQSTARRIEDAFAGIKYASPGNKKKIEQLLQDLSLWETFESKLKVKADKINLAKLKKEILEAKEHPYLD
FKSWQKFERELRLVKNQDIITWMMCRDLMEENKVEGLDIGTLYLKDIWTDVHEQGSLNVLNRVKPMRLPV
VVYRADSRGHVHKEQAPLATVYIEERDTKLLKQGNFKSFVKDRRLNGLFSFVDTGGLAMEQYPISKLRVE
YELAKYQTARVCAFEQTLELEESLLTRCPHLPDKNFRKMLESWSDPLLDKWPDLHRKVRLLIAVRNAFSH
NQYPMYDEAVFSSIRKYDPSSPDAIEERMGLNIAHRLSEEVKQAKEMAERIIQA >gi|543956136|gb|ERJ66432.1| hypothetical protein HMPREF1555_01119
[Porphyromonas gingivalis F0570] (SEQ ID NO: 73)
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRTNENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSGFLRKANRILDETAE
GKLQFSALFPEMRHRFIPPQNPKSKDRREKAETTLEKYKQEIKGRKDKLNSQLLSAPFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELHLLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDK
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDHENRF
FGKLLNNMSQPINDL >gi|543977697|gb|ERJ81654.1| hypothetical protein HMPREF1989_02374
[Porphyromonas gingivalis F0566] (SEQ ID NO: 74)
MRDLDYFETGDKPYITQTTPHYHIEKGKIGLRFVPEGQHLWPSPEVGATRTGRSKYAQDKRLTAEAFLSV
HELMPMMFYYFLLREKYSEEASAERVQGRIKRVIEDVYAVYDAFARGEIDILDRLDACLADKGIRRGHLP
RQMIAILSQEHKDMEEKIRKKLQEMMADTDHRLDMLDRQTDRKIRIGRKNAGLPKSGVIADWLVRDMMRF
QPVAKDTSGKPLNNSKANSTEYRMLQRALALFGGEKERLIPYFRQMNLIGGNNPHPFLHETRWESHINIL
SFYRSYLKARKAFLQSIGRSDRVENHRFLLLKEPKTDRQTLVAGWKGEFHLPRGIFTEAVRDCLIEMGHD
EVASYKEVGFMAKAVPLYFERACKDRVQPFYDYPFNVGNSLKPKKGRFLSKEKRAEEWESGKERFRDLEA
WSQSAVRRIEDAFAGIENASRENKKKIEQLLQDLSLWKAFESKLKVRGDKINIAKLKKEILEAKEHPYHD
FKSWQKFERELRLVKNQDIITWMMCRDLMEENKVEGLDIGTLYLKDIRTDVYEQGSLNVLNRVKPMRLPV
VVYRADSRGHVHKEQAPLATVYIEERDTKLLKQGNFKSFVKDRRLNGLFSFVDTGALAMEQYPISKLRVE
```

YELAKYQTARVCAFEQTLELEESLLTRCPHLPDKNFRKMLESWSDPLLDKWPDLHRKVRLLIAVRNAFSH
NQYPMYDEAVFSSIRKYDPSSPDAIEERMGLNIAHRLSEEVKQAKETVERIIQA

>gi|543983828|gb|ERJ87335.1| hypothetical protein HMPREF1990_01800
[Porphyromonas gingivalis W4087] (SEQ ID NO: 75)
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPRSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMDQRQLPSRLLD
EWMNIRPASHSVKLRTYVKQLNEDCRLRLQKFRKDGDGKARAIPLVGEMATFLSQDIVRMIISEETKKLI
TSAYYNEMQRSLAQYAGEENRHQFRAIVAELRLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKVMEL
LKVKDGKKKWNEAFKDWWSTKYPDGMQPFYGLRRELNIHGKSVSYIPSDGKKFADCYTHLMEKTVRDKKR
ELRTAGKPVPPDLAAYIKRSFHRAVNEREFMLRLVQEDDRLMLMAINKIMTDREEDILPGLKNIDSILDK
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEIPLIYRDVSAKVGSIEGSSAKDLPEGSSLVDSLWKKYEMIIRKILPILDPENRF
FGKLLNNMSQPINDL >gi|543999227|gb|ERJ98772.1| hypothetical protein HMPREF1218_0639
[Prevotella pleuritidis F0068] (SEQ ID NO: 76)
MENDKRLEESACYTLNDKHFWAAFLNLARHNVYITVNHINKTLELKNKKNQEIIIDNDQDILAIKTHWAK
VNGDLNKTDRLRELMIKHFPFLEAAIYSNNKEDKEEVKEEKQAKAQSFKSLKDCLFLFLEKLQEARNYYS
HYKYSESSKEPEFEEGLLEKMYNTFDASIRLVKEDYQYNKDIDPEKDFKHLERKEDFNYLFTDKDNKGKI
TKNGLLFFVSLFLEKKDAIWMQQKFRGFKDNRGNKEKMTHEVFCRSRMLLPKIRLESTQTQDWILLDMLN
ELIRCPKSLYERLQGAYREKFKVPFDSIDEDYDAEQEPFRNTLVRHQDRFPYFALRYFDYNEIFKNLRFQ
IDLGTYHFSIYKKLIGGKKEDRHLTHKLYGFERIQEFTKQNRPDKWQAIIKDLDIYETSNERYISETTPH
YHLENQKIGIRFRNDNNDIWPSLKINGEKNEKSKYNLDKPYQAEAFLSVHELLPMMFYYLLLKMENTDND
KEDNEVGIKKKGNKNNKQEKHKIEEIIENKIKDIYALYDAFINGEINSIDELAEQREGKDIEIGHLPKQL
IVILKNKSKDMAEKANRKQKEMIKDIKKRLAILDKQVKGEIEDGGRNIRLLKSGEIARWLVNDMMRFQPV
QKDNEGKPLNNSKANSTEYQMLQRSLALYNKEEKPTRYFRQVNLIKSSNPHPFLEDTKWEECYNILSFYR
NYLKAKIKFLNKLKPEDWKKNQYFLMLKEPKTNRKTLVQGWKNGFNLPRGIFTEPIKEWFKRHQNDSEEY
KKVEALDRVGLVAKVIPLFFKEEYFKEDAQKEINNCVQPFYSFPYNVGNIHKPEEKNFLHCEERRKLWDK
KKDKFKGYKAKEKSKKMTDKEKEEHRSYLEFQSWNKFERELRLVRNQDILTWLLCIKLIDKLKIDELNIE
ELQKLRLKDIDIDTAKKEKNNILNRVMPMRLPVIVYEIDKSFNIVKDKPLHIVYIEETGIKLLKQGNFKA
LVKDRRLNGLFSFVKISSEAESKSKPISKLRVEYELGAYQKARIDIIKDMLALEKTLIDNDENLPINKFS
DMLKSWLKGKGEANKARLQNDVGLLVAVRNAFSHNQYPMYNSEVFKGMKLLSLSSDIPEKEGLGIAKQLK
DKIKETIERIIEIEKEIRN >gi|545305353|ref|WP_021584635.1| hypothetical protein [Prevotella
pleuritidis] (SEQ ID NO: 77)
MENDKRLEESACYTLNDKHFWAAFLNLARHNVYITVNHINKTLELKNKKNQEIIIDNDQDILAIKTHWAK
VNGDLNKTDRLRELMIKHFPFLEAAIYSNNKEDKEEVKEEKQAKAQSFKSLKDCLFLFLEKLQEARNYYS
HYKYSESSKEPEFEEGLLEKMYNTFDASIRLVKEDYQYNKDIDPEKDFKHLERKEDFNYLFTDKDNKGKI
TKNGLLFFVSLFLEKKDAIWMQQKFRGFKDNRGNKEKMTHEVFCRSRMLLPKIRLESTQTQDWILLDMLN
ELIRCPKSLYERLQGAYREKFKVPFDSIDEDYDAEQEPFRNTLVRHQDRFPYFALRYFDYNEIFKNLRFQ
IDLGTYHFSIYKKLIGGKKEDRHLTHKLYGFERIQEFTKQNRPDKWQAIIKDLDIYETSNERYISETTPH
YHLENQKIGIRFRNDNNDIWPSLKINGEKNEKSKYNLDKPYQAEAFLSVHELLPMMFYYLLLKMENTDND
KEDNEVGIKKKGNKNNKQEKHKIEEIIENKIKDIYALYDAFINGEINSIDELAEQREGKDIEIGHLPKQL
IVILKNKSKDMAEKANRKQKEMIKDIKKRLAILDKQVKGEIEDGGRNIRLLKSGEIARWLVNDMMRFQPV
QKDNEGKPLNNSKANSTEYQMLQRSLALYNKEEKPTRYFRQVNLIKSSNPHPFLEDTKWEECYNILSFYR
NYLKAKIKFLNKLKPEDWKKNQYFLMLKEPKTNRKTLVQGWKNGFNLPRGIFTEPIKEWFKRHQNDSEEY
KKVEALDRVGLVAKVIPLFFKEEYFKEDAQKEINNCVQPFYSFPYNVGNIHKPEEKNFLHCEERRKLWDK
KKDKFKGYKAKEKSKKMTDKEKEEHRSYLEFQSWNKFERELRLVRNQDILTWLLCIKLIDKLKIDELNIE
ELQKLRLKDIDIDTAKKEKNNILNRVMPMRLPVIVYEIDKSFNIVKDKPLHIVYIEETGIKLLKQGNFKA
LVKDRRLNGLFSFVKISSEAESKSKPISKLRVEYELGAYQKARIDIIKDMLALEKTLIDNDENLPINKFS
DMLKSWLKGKGEANKARLQNDVGLLVAVRNAFSHNQYPMYNSEVFKGMKLLSLSSDIPEKEGLGIAKQLK
DKIKETIERIIEIEKEIRN >gi|545424591|ref|WP_021663197.1| hypothetical protein [Porphyromonas
gingivalis] (SEQ ID NO: 78)
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPRSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMDQRQLPSRLLD
EWMNIRPASHSVKLRTYVKQLNEDCRLRLQKFRKDGDGKARAIPLVGEMATFLSQDIVRMIISEETKKLI
TSAYYNEMQRSLAQYAGEENRHQFRAIVAELRLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI

```
LIRNKAAHNQFPCAAEMPLIYRDVSAKVGSIEGSSAKDLPEGSSLVDSLWKKYEMIIRKILPILDPENRF
FGKLLNNMSQPINDL
```

>gi|545427058|ref|WP_021665475.1| hypothetical protein [*Porphyromonas gingivalis*] (SEQ ID NO: 79)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRTNENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSGFLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDK
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDHENRF
FGKLLNNMSQPINDL
```

>gi|545440038|ref|WP_021677657.1| hypothetical protein [*Porphyromonas gingivalis*] (SEQ ID NO: 80)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSGFLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDHENRF
FGKLLNNMSQPINDL
```

>gi|545442698|ref|WP_021680012.1| hypothetical protein [*Porphyromonas gingivalis*] (SEQ ID NO: 81)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPRSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMDQRQLPSRLLD
EWMNIRPASHSVKLRTYVKQLNEDCRLRLQKFRKDGDGKARAIPLVGEMATFLSQDIVRMIISEETKKLI
TSAYYNEMQRSLAQYAGEENRHQFRAIVAELRLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKVMEL
LKVKDGKKKWNEAFKDWWSTKYPDGMQPFYGLRRELNIHGKSVSYIPSDGKKFADCYTHLMEKTVRDKKR
ELRTAGKPVPPDLAAYIKRSFHRAVNEREFMLRLVQEDDRLMLMAINKIMTDREEDILPGLKNIDSILDK
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEIPLIYRDVSAKVGSIEGSSAKDLPEGSSLVDSLWKKYEMIIRKILPILDPENRF
FGKLLNNMSQPINDL
```

>gi|563396328|gb|ETA27404.1| hypothetical protein SJDPG2_03560 [*Porphyromonas gingivalis* SJD2] (SEQ ID NO: 82)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPRSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
```

-continued
```
LIRNKAAHNQFPCAAEMPLIYRDVSAKVGSIEGSSAKDLPEGSSLVDSLWKKYEMIIRKILPILDPENRF
FGKLLNNMSQPINDL
```

>gi|564601847|ref|WP 023846767.1| hypothetical protein [Porphyromonas
gingivalis] (SEQ ID NO: 83)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPRSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL
```

>gi|567226320|dbj|GAE20957.1| hypothetical protein JCM10003_349
[Bacteroides pyogenes JCM 10003] (SEQ ID NO: 84)
```
MESIKNSQKSIGKILQKDPPYFGLYLNMALLNVRKVENHIRKWLGVDVALLPEKSGFHSLLTIDNLSSAKW
TRFYYKSRKFLPFLEMFDSDKKSYENRRETAECLDTIDRQKISSLLKEVYGKLQDIRNAFSHYHIDDQSV
KHTALIISSEMHRFIENAYSFALQKTRARFTGVFVETDFLQAEEKGDNKKFFAIGGNEGIKLKDNALIFL
ICLFLDREEAFKFLSRATGFKSTKEKGFLAVRETFCALCCRQPHERLLSVNPREALLMDMLNELNRCPDI
LFEMLDEKDQKSFLPLLGEEEQAHILENSLNDELCEAIDDPFEMIASLSKRVRYKNRFPYLMLRYIEEKN
LLPFIRFRIDLGCLELASYPKKMGEENNYERSVIDHAMAFGRLTDFHNEDAVLQQIIKGITDEVRFSLYA
PRYAIYNNKIGVRTSGSDKISFPILKKKGGEGHCVAYTLQNIKSFGFISIYDLRKILLLSFLDKDKAKN
IVSGLLEQCEKHWKDLSENLFDAIRTELQKEFPVPLIRYTLPRSKGGKLVSSKLADKQEKYESEFERRKE
KLTEILSEKDFDLSQIPRRMIDEWLNVLPTSREKKLKGYVETLKLDLCRERLRVFEKREKGEHPLPPRIGE
MAIDLAKDIIRMVIDQGVKQRITSAYYSEIQRCLAQYAGDDNRRHLDSIIRELRLKDTKNGHPFLGKVLR
PGLGHTEKLYQRYFEEKKEWLEATFYPAASPKRVPRFVNPPIGKQKELPLIIRNLMKERPEWRDWKQRKN
SHPIDLPSQLFENEICRLLKDKIGKEPSGKLKWNEMFKLYWDKEFPNGMQRFYRCKRRVEVFDKVVEYEY
SEEGGNYKKYYEALIDEVVRQKISSSKEKSKLQVEDLILSVRRVFKRAINEKEYQLRLLCEDDRLLFMAV
RDLYDWKEAQLDLDKIDNMLGEPVSVSQVIQLEGGQPDAVIKAECKLKDVSKLMRYCYDGRVKGLMPYFA
NHEATQEQVEMELRHYEDHRRRVFNWVFALEKSVLKNEKLRRFYEESQGGCEHRRCIDALRKASLVSEEE
YEFLVHIRNKSAHNQFPDLEIGKLPPNVISGFCECIWSKYKAIICRIIPFIDPERRFFGKLLEQK
```

>gi|640570032|ref|WP 025000926.1| hypothetical protein [Prevotella
aurantiaca] (SEQ ID NO: 85)
```
MEDDKTIGSISYELKDKHFWAAFLNLARHNVYITINHINKLLEIREIDNDEKVLDIKTLWQKGNKDLNQ
KARLRELMTKHPPFLETAIYIKNKEDKKEVKQEKQAEAQSLESLKDCLFLFDKLQEARNYYSHYKYSEF
SKEPEFEEGLLEKMYNIFGNNIQLVINDYQHNKDINPDEDFKHLDRKGQFKYSFADNEGNITESGLLFFV
SLFLEKKDAIWMQQKLNGFKDNLENKKKMTHEVFCRSRILMPKLRLESTQTQDWILLDMLNELIRCPKSL
YERLQGDDREKFKVPFDPADEDYNAEQEPFKNTLIRHQDRFPYFVLRYFDYNEIFKNLRFQIDLGTYHFS
IYKKLIGGQKEDRHLTHKLYGFERIQEFAKQNRPDEWKAIVKDLDIYETSNKRYISETTPHYHLENQKIG
IRFRNGNKEIWPSLKINDENNEKSKYKLLDKQYQAEAFLSVHELLPMMFYYLLLKKEKPNNDEINASIVEG
FIKREIRNIFKLYDAFANGEINNIDDLEKYCADKGIPKRHLPKQMVAILYDEHKDMVKEAKRKQKEMVKD
TKKLLATLEKQTQKEKEDDGRNVKLLKSGEIARWLVNDMMRFQPVQKDNEGKPLNNSKANSTEYQMLQRS
LALYNNEEKPTRYFRQVNLIESNNPHPFLKWIKWEECNNILIFYYSYLIKKIEFLNKLKPEDWKKNQYFL
KLKEPKTNRETLVQGWKNGFNLPRGIFTEPIREWFKRHQNNSKEYKVEALDRVGLVTKVIPLFFKEEYF
KDKEENFKEDTQKEINDCVQPFYNFPYNVGNIHKPKEKDFLHREERIELWDKKKDKFKGYKEKIKSKKLT
EKDKEEFRSYLEFQSWNKFERELRLVRNQDIVTWLLCKELIDKLKIDELNIEELKKLRLNNIDIDITAKKE
KNNILNRVMPMELPVIVYEIDDSHKIVKDKPLHTIYIKEAETKLLKQGNFKALVKDRRLNGLFSFVKINS
EAESKRNPISKLRVEYELGEYQEARIEIIQDMLALEEKLINKYKDLPINKFSEMLNSWLEGKDEADKARF
QNDVDFLIAVRNAFSHNQYPMHNKIEFANIKPFSLYTANNSEEKGLGIANQLKDKIKETTDKIKKIEKPI
ETKE
```

>gi|672596632|gb|AIJ35608.1| hypothetical protein EG14_06045
[Porphyromonas gingivalis] (SEQ ID NO: 86)
```
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFAVFFKPDDFVLAKNRKEQLISVADGKECLIVSGFAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLDEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMDQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELRLLDPSSGHPFLSATMETAHRYTEGFYKCYLEKKREWLA
KIFYRPEQDENTKRRISVFFVPDGEARKLLPLLIRRRMKEQNDLQDWIRNKQAHPIDLPSHLFDSKVMEL
LKVKDGKKKWNEAFKDWWSTKYPDGMQPFYGLRRELNIHGKSVSYIPSDGKKFADCYTHLMEKTVRDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL
```

>gi|672597416|gb|AIJ36392.1| hypothetical protein EG14_10345
[Porphyromonas gingivalis] (SEQ ID NO: 87)
MTEQNERPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREGIVTEAGLLFFVSLFLEKRDAIWMQKKIRGFKGGTEAYQQMTNEVFCRSRISLP
KLKLESLRIDDWMLLDMLNELVRCPKSLYDRLREEDRARFRVPIDILSDEDDIDGTEEDPFKNILVRHQD
RPPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRLTAEAFLS
VHELMPMMFYYFLLREKYSEEVSAEKVQGRIKRVIEDVYAVYDAFARGEIDILDRLDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDREENHRFLLLKEPKTDRQTLVAGWKSEFHLPRGIFTEAVRDCLIEMGY
DEVGSYKEVGFMAKAVPLYFERACKDRVQPFYDYPFNVGNSLKPKKGRFLSKEKRAEEWESGKERFRLAK
LKKEILEAKEHPYLDFKSWQKFERELRLVKNQDIITWMMCRDLMEENKVEGLDIGTLYLKDIRTDVHEQG
SLNVLNRVKPMRLPVVVYRADSRGHVHKEQAPLATVYIEERDTKLLKQGNFKSFVKDRRLNGLFSFVDTG
ALAMEQYPISKLRVEYELAKYQTARVCAFEQTLELEESLLTRYPHLPDKNFRKMLESWSDPLLDKWPDLH
RKVRLLIAVRNAFSHNQYPMYDEAVFSSIRKYDPSSPDAIEERMGLNIAHRLSEEVKQAKEMAERIIQV >gi|690716823|gb|KGE88582.1| hypothetical protein IX84_07840
[Phaeodactylibacter xiamenensis] (SEQ ID NO: 88)
MINTPKRRILHRHPSYFGAFLNIARHNAFMIMEHLSTKYDMEDKNILDEAQLPNAKLFGCLKKRYGKPDV
TEGVSRDLRRYPFPLNYPLFLHLEKQQNAEQAATYDINPEDIEFILKGFFRLLNQMRNNYSHYISNIDYG
KFDKLPVQDIYEAAIFRLLDRGKHTKRFDVFESKHIRHLESNNSEYRPRSLANSPDHENTVAFVTCLFLE
RKYAFPPLSRLDCFRSINDAAEGDPLIRKASHECYTMFCCRLPQPKLSSDILLDMVNELGRCPSALYNL
LSEEDQARFHIKREEITGFEEDPDEELEQEIVLKRHSDRFPYFALRYFDDTEAFQTLRFDVYLGRWRIKP
VYKKRIYGQERDRVLIQSIRTFIRLSRLLPIYENVKHDAVRQNEEDGKLVNPDVISQFHKSWIQIESDDR
AFLSDRIEHFSPHYNFGDQVIGLKFINPDRYAAIQNVFPKLPGEEKKDKDAKLVNETADAIISTHEIRSL
FLYHYLSKKPISAGDERRFIQVDTETFIKQYIDTIKLFFEDIKSGELQPIADPPNYQKNEPLPYVRGDKE
KTQEERAQYRERQKEIKERRKELNILLQNRYGLSIQYIPSRLREYLLGYKKVPYEKLALQKLRAQRKEVK
KRIKDIEKMRTPRVGEQATWLAEDIVFLIPPKMHIPERKTIKHPQKLNNDQPRIMQSSLAYFSVNKKAIK
KFFQKETGIGLSNRETSHPFLYRIDVGRCRGILDFYIGYLKYKMDWLDDAIKKVDNRKHGKKEAKKYEKY
LPSSIQHKTPLELDYIRLPVYLPRGLFKKAIVKALAAHADFQVEPEEDNVIFCLDQLLDGDTQDFYNWQR
YYRSALTEKEIDNQLVLAHPYAEQILGTIKTLEGKQKNNKLGNKAKQKIKDELIDLKRAKRRLLDREQYL
RAVQAEDRALWLMIQERQKQKAEHEEIAFDQLDLKNITKILTESIDARLRIPDTKVDITDKLPLRRYGDL
RRVAKDRRLVNLASYYHVAGLSEIPYDLVKKELEEYDRRRVAFFEHVYQFEKEVYDRYAAELRNENPKGE
STYFSHWEYVAVAVKHSADTHFNELFKEKVMQLRNKFHHNEFPYFDWLLPEVEKASAALYADRVFDVAEG
YYQKMRKLMRQ >gi|696209666|gb|KGL48767.1| hypothetical protein HQ49_06245
[Porphyromonas gulae] (SEQ ID NO: 89)
MTEQSERPYNGTYYTLEDKHFWAAFLNLARHNAYITLTHIDRQLAYSKADITNDQDVLSFKALWKNLDND
LERKSRLRSLILKHFSFLEGAAYGKKLFESKSSGNKSSKNKELIKKEKEELQANALSLDNLKSILFDFLQ
KLKDFRNYYSHYRHSGSSELPFLDGNMLQRLYNVFDVSVQRVKRDHEHNDKVDPHRHFNHLVRKGKKDRY
GHNDNPSFKHHFVDSEGMVTEAGLLFFVSLFLEKRDAIWMQKKIRGFKGGTETYQQMTNEVFCRSRISLP
KLKLESLRMDDWMLLDMLNELVRCPKPLYDRLREDDRACFRVPVDILPDEDDIDGGGEDPFKNILVRHQD
RPPYFALRYFDLKKVFTSLRFHIDLGTYHFAIYKKMIGEQPEDRHLTRNLYGFGRIQDFAEEHRPEEWKR
LVRDLDYFETGDKPYISQTSPHYHIEKGKIGLRFMPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIAILSQEHKNMEEKVRKKLQEMIADTDHRLDMLDRQTDRKIRIGRKNAGLPKSGVIADWLVRDMMR
FQPVAKDASGKPLNNSKANSTEYRMLQRALALFGGEKERLIPYFRQMNLIGGNNPHPFLHDTRWESHINI
LSFYRSYLRARKAFLERIGRSDRMENRPFLLLKEPKTDRQTLVAGWKSEFHLPRGIFTEAVRDCLIEMGY
DEVGSYREVGFMAKAVPLYFERACEDRVQPFYDSPFNVGNSLKPKKGRFLSKEERAEEWERGKERFRDLE
AWSHSAARRIEDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRTNVQEQGSLNVLNHVKPMRLP
VVVYRADSRGHVHKEEAPLATVYIEERDTKLLKQGNFKSFVKDRRLNGLFSFVDTGGLAMEQYPISKLRV
EYELAKYQTARVCAFEQTLELEESLLTRYPHLPDKNFRKMLESWSDPLLAKWPELHGKVRLLIAVRNAFS
HNQYPMYDEAVFSSIRKYDPSSPDAIEERMGLNIAHRLSEEVKQAKETVERIIQA >gi|696216474|gb|KGL55352.1| hypothetical protein HQ50_05870
[Porphyromonas sp. COT-052 OH4946] (SEQ ID NO: 90)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSESSELPFLDGNMLQRLYNVFDVSVQRVKRDHEHNDKVDPHRHFNHLVRKGKKDRY
GHNDNPSFKHHFVDSEGMVTEAGLLFFVSLFLEKRDAIWMQKKIRGFKGGTETYQQMTNEVFCRSRISLP
KLKLESLRIDDWMLLDMLNELVRCPKPLYDRLREDDRACFRVPVDILPDEDDIDGGGEDPFKNILVRHQD
RPPYFALRYFDLKKVFTSLRFHIDLGTYHFAIYKKMIGEQPEDRHLTRNLYGFGRIQDFAEEHRPEEWKR
LVRDLDYFETGDKPYISQTTPHYHIEKGKIGLRFVPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIGILSQERKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLRARKAFLERIGRSDRVENCPFLLLKEPKTDRQTLVAGWKGEFHLPRGIFTEAVRDCLIEMGY
DEVGSYREVGFMAKAVPLYFERACEDRVQPFYDSPFNVGNSLKPKKGRFLSKEDRAEEWERGKERFRDLE
AWSHSAARRIKDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLSRYPHLPDESFREMLESWSDPLLAKWPELHGKVRLLIAVRNAFS
HNQYPMYDEAVFSSIRKYDPSSPDAIEERMGLNIAHRLSEEVKQAKETVERIIQA >gi|700219215|gb|KGN69120.1| hypothetical protein HR09_05855
[Porphyromonas gulae] (SEQ ID NO: 91)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSESSELPLFDGNMLQRLYNVFDVSVQRVKRDHEHNDKVDPHRHFNHLVRKGKKDRY
GHNDNPSFKHHFVDGEGMVTEAGLLFFVSLFLEKRDAIWMQKKIRGFKGGTETYQQMTNEVFCRSRISLP
KLKLESLRIDDWMLLDMLNELVRCPKPLYDRLREDDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTSPHYHIEKGKIGLRFMPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIAILSQEHKDMEEKIRKKLQEMIADTDHRLDMLDRQTDRKIRIGRKNAGLPKSGVIADWLVRDMMR
FQPVAKDTSGKPLNNSKANSTEYRMLQRALALFGGEKKRLIPYFRQMNLIGGNNPHPFLHETRWESHINI
LSFYRSYLRARKAFLERIGRSDRMENRPFLLLKEPKTDRQTLVAGWKSEFHLPRGIFTEAVRDCLIEMGY
DEVGSYREVGFMAKAVPLYFERACEDRVQPFYDSPFNVGNSLKPKKGRFLSKEERAEEWERGKERFRDLE
AWSHSAARRIEDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRLNGLFSFVDTGGLAMEQYPISKLRV
EYELAKYQTARVCVFELTLRLEESLLTRYPHLPDESFRKMLESWSDPLLAKWPELHGKVRLLIAVRNAFS
HNQYPMYDEAVFSSIRKYDPSSPDAIEERMGLNIAHRLSEEVKQAKETVERIIQV >gi|700224863|gb|KGN74647.1| hypothetical protein HR17_04485
[Porphyromonas gulae] (SEQ ID NO: 92)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKIDHEHNDEVDPHYHFNHLVRKGKKDRY
GHNDNPSFKHHFVDGEGMVTEAGLLFFVSLFLEKRDAIWMQKKIRGFKGGTETYQQMTNEVFCRSRISLP
KLKLESLRMDDWMLLDMLNELVRCPKPLYDRLREDDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTSPHYHIEKGKIGLRFMPEGQHLWPSPEVGITRTGRSKYAQDKRLTAEAFLS
VHELMPMMFYYFLLREKYSEEVSAERVQGRIKRVIEDVYAVYDAFARDEINTRDELDACLADKGIRRGHL
PRQMIAILSQEHKDMEEKIRKKLQEMMADTDHRLDMLDRQTDRKIRIGRKNAGLPKSGVIADWLVRDMMR
FQPVAKDASGKPLNNSKANSTEYRMLQRALALFGGEKERLIPYFRQMNLIGGNNPHPFLHETRWESHINI
LSFYRSYLRARKAFLERIGRSDRVENRPFLLLKEPKTDRQTLVAGWKSEFHLPRGIFTEAVRDCLIEMGH
DEVASYKEVGFMAKAVPLYFERACEDRVQPFYDSPFNVGNSLKPKKGRFLSKEERAEEWERGKERFRDLE
AWSYSAARRIEDAFAGIEYASPGNKKKIEQLLRDLSLWEAFESKLKVRADRINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLTRYPHLPDESFREMLESWSDPLLAKWPELHGKVRLLIAVRNAFS
HNQYPMYDEAVFSSIRKYDPSSPDAIEERMGLNIAHRLSEEVKQAKETVERIIQA >gi|700226261|gb|KGN76020.1| hypothetical protein HQ40_04325
[Porphyromonas gulae] (SEQ ID NO: 93)
MNIVPATENKGQSRIVEDDPQYFGLYLNLARENLIEVESHVRIKFGKKKLNEESLKQSLLCDHLLSIDRW
TKVYGHSRRYLPFLHCFDPDSGIEKDHDSKTGVDPDSAQRLIRELYSLLDFLRNDFSHNRLDGITFEHLK
VSPDISSFITGAYTFACERAQSRFADFFKPDDFLLAKNRKEQLISVADGKECLIVSGFAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVRDKKR
ELRTAGKPVPPDLAAYIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDHENRF
FGKLLNNMSQPINDL >gi|700235983|gb|KGN85385.1| hypothetical protein HR15_09830
[Porphyromonas gulae] (SEQ ID NO: 94)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKRDHEHNDKVDPHYHFNHLVRKGKKDRY
GHNDNPSFKHHFVDSEGMVTEAGLLFFVSLFLEKRDAIWMQKKIRGFKGGIGPYEQMTNEVFCRSRISLP
KLKLESLRIDDWMLLDMLNELVRCPKPLYDRLREKDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTTPHYHIEKGKIGLRFMPEGQHLWPSPEVGITRTGRSKYAQDKRLTAEAFLS
VHELMPMMFYYFLLREKYSEEVSAEKVQGRIKRVIKDVYAIYDAFARDEINTLKELDACSADKGIRRGHL
PKQMIGILSQEHKNMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLDETRWESHINI
LSFYRSYLRARKAFLERIGRSDRVENRPFLLLKEPKNDRQTLVAGWKSEFHLPRGIFTEAVRDCLIEMGY
DEVGSYKEVGFMAKAVPLYFERACKDRVQPFYDSPFNVGNSLKPKKGRFLSKEKRAEEWESGKERFRLAK
LKKEILEAKEHPYHDFKSWQKFERELRLVKNQDIITWMMCRDLMEENKVEGLDIGTLYLKDIRTDVHEQG
SLNVLNRVKPMRLPVVVYRADSRGHVHKEQAPLATVYIEERDTKLLKQGNFKSFVKDRRLNGLFSFVDTG
GLAMEQYPISKLRVEYELAKYQTARVCAFEQTLELEESLLTRYPHLPDENFREMLESWSDPLLGKWPDLH
GKVRLLIAVRNAFSHNQYPMYDEAVFSSIRKYDPSSPDAIEERMGLNIAHRLSEEVKQAKETVERIIQA >gi|700238026|gb|KGN87312.1| hypothetical protein HQ46_09365
[*Porphyromonas gulae*] (SEQ ID NO: 95)
MTEQSERPYNGTYYTLEDKHFWAAFLNLARHNAYITLTHIDRQLAYSKADITNDQDVLSFKALWKNLDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKRDHEHNDKVDPHYHFNHLVRKGKKDRY
GHNDNPSFKHHFVDSEGMVTEAGLLFFVSLFLEKRDAIWMQKKIRGFKGGIGPYEQMTNEVFCRSRISLP
KLKLESLRIDDWMLLDMLNELVRCPKPLYDRLREKDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYLETGDKPYISQTTPHYHIEKGKIGLRFVPEGQHLWPSPEVGITRTGRSKCAQDKRLTAEAFLS
VHELMPMMFYYFLLREKYSEEVSAEKVQGRIKRVIEDVYAIYDAFARDEINTLKELDTCLADKGIRRGHL
PKQMITILSQERKDMKEKIRKKLQEMIADTDHRLDMLDRQTDRKIRIGRKNAGLPKSGVIADWLVRDMMR
FQPVAKDASGKPLNNSKANSTEYRMLQRALALFGGEKERLIPYFRQMNLIGGNNPHPFLHETRWESHINI
LSFYRSYLRARKAFLERIGSDRVENCPFLLLKEPKTDRQTLVAGWKDEFHLPRGIFTEAVRDCLIEMGY
DEVGSYREVGFMAKAVPLYFERACEDRVQPFYDSPFNVGNSLKPKKGRFLSKEDRAEEWERGMERFRDLE
AWSHSAARRIKDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEAPLATVYIEERNIKLLKQGNFKSFVKDRRLNGLFSFVDTGGLAMEQYPISKLRVE
YELAKYQTARVCVFELTLRLEESLLSRYPHLPDESFREMLESWSDPLLAKWPELHGKVRLLIAVRNAFSH
NQYPMYDEAVFSSIRKYDPSSPDAIEERMGLNIAHRLSEEVKQAKETVERIIQA >gi|700239027|gb|KGN88274.1| hypothetical protein HR08_00310
[*Porphyromonas gulae*] (SEQ ID NO: 96)
MTEQSERPYNGTYYTLEDKHFWAAFLNLARHNAYITLTHIDRQLAYSKADITNDQDVLSFKALWKNLDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKRDHEHNDKVDPHRHFNHLVRKGKKDRY
GHNDNPSFKHHFVDGEGMVTEAGLLFFVSLFLEKRDAIWMQKKIRGFKGGTETYQQMTNEVFCRSRISLP
KLKLESLRIDDWMLLDMLNELVRCPKPLYDRLREKDRARFRVPVDILPDEDDIDGGGEDPFKNILVRHQD
RFPYFALRYFDLKKVFTSLRFHIDLGTYHFAIYKKVIGEQPEDRHLTRNLYGFGRIQDFAEEHRPEEWKR
LVRDLDYFETGDKPYISQTTPHYHIEKGKIGLRFVPEGQHLWPSPEVGITRTGRSKYAQDKRLTAEAFLS
VHELMPMMFYYFLLREKYSEEVSAEKVQGRIKRVIEDVYAIYDAFARDEINTRDELDACLADKGIRRGHL
PKQMIGILSQEHKNMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLDETRWESHINI
LSFYRSYLRARKAFLERIGRSDRVENRPFLLLKEPKTDRQTLVAGWKFHLPRGIFTEAVRDCLIEMGY
DEVGSYKEVGFMAKAVPLYFERACKDRVQPFYDSPFNVGNSLKPKKGRFLSKEKRAEEWESGKERFRLAK
LKKEILEAQEHPYHDFKSWQKFERELRLVKNQDIITWMMCRDLMEENKVEGLDIGTLYLKDIRPNVQEQG
SLNVLNRVKPMRLPVVVYRADSRGHVHKEEAPLATVYIEERDTKLLKQGNFKSFVKDRRLNGLFSFVDTG
GLAMEQYPISKLRVEYELAKYQTARVCVFELTLRLEESLLSRYPHLPDESFREMLESWSDPLLAKWPELH
GKVRLLIAVRNAFSHNQYPMYDEAVFSSIRKYDPSSPDAIEERMGLNIAHRLSEEVKQAKETVERIIQA >gi|700263343|gb|KG005347.1| hypothetical protein HR16_00525
[*Porphyromonas gulae*] (SEQ ID NO: 97)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKIDHEHNDEVDPHYHFNHLVRKGKKDRY
GHNDNPSFKHHFVDGEGMVTEAGLLFFVSLFLEKRDAIWMQKKIRGFKGGTETYQQMTNEVFCRSRISLP
KLKLESLRMDDWMLLDMLNELVRCPKPLYDRLEDDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTSPHYHIEKGKIGLRFMPEGQHLWPSPEVGITRTGRSKYAQDKRLTAEAFLS
VHELMPMMFYYFLLREKYSEEVSAERVQGRIKRVIEDVYAVYDAFARDEINTRDELDACLADKGIRRGHL
PRQMIAILSQEHKDMEEKIRKKLQEMMADTDHRLDMLDRQTDRKIRIGRKNAGLPKSGVIADWLVRDMMR
FQPVAKDASGKPLNNSKANSTEYRMLQRALALFGGEKERLIPYFRQMNLIGGNNPHPFLHETRWESHINI
LSFYRSYLRARKAFLERIGRSDRVENPFLLLKEPKTDRQTLVAGWKGEFHLPRGIFTEAVRDCLIEMGH
DEVASYKEVGFMAKAVPLYFERACEDRVQPFYDSPFNVGNSLKPKKGRFLSKEERAEEWERGKERFRDLE
AWSYSAARRIEDAFAGIEYASPGNKKKIEQLLRDLSLWEAFESKLKVRADRINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLTRYPHLPDESFREMLESWSDPLLAKWPELHGKVRLLIAVRNAFS
HNQYPMYDEAVFSSIRKYDPSSPDAIEERMGLNIAHRLSEEVKQAKETVERIIQA >gi|736527371|ref|WP_034542281.1| hypothetical protein [*Bacteroides pyogenes*] (SEQ ID NO: 98)
MESIKNSQKSIGKILQKDPPYFGLYLNMALLNVRKVENHIRKWLGDVALLPEKSGFHSLLTIDNLSSAKW
TRFYYKSRKFLPFLEMFDSDKKSYENRRETAECLDTIDRQKISSLLKEVYGKLQDIRNAFSHYHIDDQSV
KHTALIISSEMHRFIENAYSFALQKTRARFTGVFVETDFLQAEEKGDNKFFAIGGNEGIKLKDNALIFL
ICLFLDREEAFKFLSRATGFKSTKEKGFLAVRETFCALCCRQPHERLLSVNPREALLMDMLNELNRCPDI
LFEMLDEKDQKSFLPLLGEEEQAHILENSLNDELCEAIDDPFEMIASLSKRVRYKNRFPYLMLRYIEEKN
LLPFIRFRIDLGCLELASYPKKMGEENNYERSVIDHAMAFGRLTDFHNEDAVLQQIIKGITDEVRFSLYA
PRYAIYNNKIGFVRTSGSDKISFPILKKKGGEGHCVAYTLQNIKSFGFISIYDLRKILLLSFLDKDKAKN
IVSGLLEQCEKHWKDLSENLFDAIRTELQKEFPVPLIRYTLPRSKGGKLVSSKLADKQEKYESEFERRKE
KLTEILSEKDFDLSQIPRRMIDEWLNVLPTSREKKLKGYVETLKLDCRERLRVFEKREKGEHPLPPRIGE
MAIDLAKDIIRMVIDQGVKQRITSAYYSEIQRCLAQYAGDDNRRHLDSIIRELRLKDTKNGHPFLGKVLR
PGLGHTEKLYQRYFEEKKEWLEATFYPAASPKRVPRFVNPPIGKQKELPLIIRNLMKERPEWRDWKQRKN
SHPIDLPSQLFENEICRLLKDKIGKEPSGKLKWNEMFKLYWDKEFPNGMQRFYRCKRRVEVFDKVVEYEY
SEEGGNYKKYYEALIDEVVRQKISSSKEKSKLQVEDLILSVRRVFKRAINEKEYQLRLLCEDDRLLFMAV
RDLYDWKEAQLDLDKIDNMLGEPVSVSQVIQLEGGQPDAVIKAECKLKDVSKLMRYCYDGRVKGLMPYFA
NHEATQEQVEMELRHYEDHRRRVFNWVFALEKSVLKNEKLRRFYEESQGGCEHRRCIDALRKASLVSEEE
YEFLVHIRNKSAHNQFPDLEIGKLPPNVISGFCECIWSKYKAIICRIIPFIDPERRFFGKLLEQK >gi|738977489|ref|WP_036860899.1| hypothetical protein [*Prevotella intermedia*] (SEQ ID NO: 99)

-continued

```
MEDDKKTIDSIRYELKDKHFWAAFLNLARHNVYITVNHINKILEEGEINRDGYETTLKNIWNEIKDINKK
DRLSKLIIKHFPFLEAATYRLNPIDTTKQKEEKQAEAQSLESLRKSFFVFIYKLRDLRNHYSHYKHSKSL
ERPKFEEGLLEKMYNIFNASIRLVKEDYQYNKDINPDEDFKHLDRTEEEFNYYFTKDNEGNITESGLLFF
VSLFLEKKDAIWMQQKLRGFKDNRENKKKMTNEVFCRSRMLLPKLRLQSTQTQDWILLDMLNELIRCPKS
LYERLREEDREKFRVPIEIADEDYDAEQEPFKNILVRHQDRFPYFALRYFDYNEIFTNLRFQIDLGTYHF
SIYKKQIGDYKESHHLTHKLYGFERIQEFTKQNRPDEWRKFVKIFNSFETSKEPYIPETTPHYHLENQKI
GIRFRNDNDKIWPSLKINSEKNEKSKYKLDKSFQAEAFLSVHELLPMMFYYLLLKTENTDNDNEIETKKK
ENKNDKQEKHKIEEIIENKITEIYALYDTFANGEIKSIDELEEYCKGKDIEIGHLPKQMIAILKDEHKVM
ATEAERKQEEMLVDVQKSLESLDNQINEEIENVERKNSSLKSGKIASWLVNDMMRFQPVQKDNEGKPLNN
SKANSTEYQLLQRTLAFFGSEHERLAPYFKQTKLIESSNPHPFLKDIEWEKCNNILSFYRSYLEAKKNFL
ESLKPEDWEKNQYFLKLKEPKTKPKTLVQGWKNGFNLPRGIFTEPIRKWFMKHRENITVAELKRVGLVAK
VIPLFFSEEYKDSVQPFYNYHFNVGNINKPDEKNFLNCEERRELLRKKKDEFKKMTDKEKEENPSYLEFK
SWNKFERELRLVRNQDIVTWLLCMELFNKKKIKELNVEKIYLKNININTIKKEKNTEEKNGEEKNIKEKN
NILNRIMPMRLPIKVYGRENFSKNKKKKIRRNIFFTVYIEEKGTKLLKQGNFKALERDRRLGGLFSFVKT
PSKAESKSNTISKLRVEYELGEYQKARIEIIKDMLALEKTLIDKYNSLDIDNFNKMLIDWLELKGEPDKA
SFQNDVDLLIAVRNAFSHNQYPMRNRIAFANINPFSLSSANTSEEKGLGIANQLKDKIHKTIEKIIEIEK
PIETKE
```

>gi|739003017|ref|WP_036884929.1| hypothetical protein [Prevotella falsenii] (SEQ ID NO: 100)
```
MKNDNNSTKSIDYTLGDKHFWAAFLNLARHNVYITVNHINKVLELKNKKDQEIIIDNDQDILAIKTLWGK
VDTDINKKDRLRELIMKHFPFLEAATYQQSSINNTKQKEEEQAKAQSFESLKDCLFLFLEKLREARNYYS
HYKHSKSLEEPKLEEKLLENMYNIFDINVQLVIKDYEHNKDINPEEDFKHLGRAEGEFNYYFTRNKKGNI
TESGLLFFVSLFLEKKDAIWAQTKIKGFKDNRENKQKMTHEVFCRSRMLLPKLRLESTQTQDWILLDMLN
ELIRCPKSLYKRLQGEKREKFRVPFDPADEDYDAEQEPFKNILVRHQDRFPYFALRYFDYNEIFTNLRFQ
IDLGTYHFSIYKKQIGDKKEDRHLTHKLYGFERIQEFAKENRPDEWKALVKDLDIFEESNEPYISETTPH
YHLENQKIGIRNKNKKKKTIWPSLETKTIVNERSKYNLGKSFKAEAFLSVHELLPMMFYYLLLNKEEPN
NGKINASKVEGIIEKKIRDIYKLYGAFANEEINNEEELKEYCEGKDIAIRHLPKQMIAILKNEYKDMAKK
AEDKQKKMIKDIKKRLAALDKQVKGEVEDGGRNIKPLKSGRIASWLVNDMMRFQPVQRDRDGYPLNNSKA
NSTEYQLLQRTLALFGSERERLAPYFRQMNLIGKDNPHPFLKDTKWKEHNNILSFYRSYLEAKKNFLGSL
KPEDWKKNQYFLKLKEPKTNRETLVQGWKNGFNLPRGIFTEPIREWFIRHQNESEEYKKVKDFDRIGLVA
KVIPLFFKEDYQKEIEDYVQPFYGYPPFNVGNIHNSQEGTFLNKKEREELWKGNKTKFKDYKTKEKNKEKT
NKDKFKKKIDEEKEEFRSYLDFQSWKKFERELRLVRNQDIVTWLLCMELIDKLKIDELNIEELQKLRLKD
IDIDTAKKEKNNILNRIMPMELPVIVYETDDSNNIIKDKPLHTIYIKEAETKLLKQGNFKALVKDRRLNG
LFSFVETSSEAELKSKPISKSLVEYELGEYQRARVEIIKDMLRLEETLIGNDEKLPINKFRQMLDKWLEH
KKETDDIDLKNDVKLLTEVRNAFSHNQYPMRDRIAFANIKPFSLSSANTSNEEGLGIAKKLKDKIKETID
RIIEIEEQTATKR
```

>gi|739057304|ref|WP_036929175.1| hypothetical protein [Prevotella sp. MA2016] (SEQ ID NO: 101)
```
MSKECKKQRQEKKRRLQKANFSISLIGKHVFGAYFNMARINFVKTINYILPIAGVRGNYSENQINKMLHA
LFLIQAGRNEELTTEQKQWEKKLRLNPEQQTKFQKLLFKHFPVLGPMMADVADHKAYLNKKKSTVQTEDE
TFAMLKGVSLADCLDIICLMADILTECRNFYTHKDPYNKPSQLADQYLQEMIAKKLDKVVVASRRILKD
REGLSVNEVEFLIGIDHLHQEVLKDEFGNAKVKDGKVMKTFVEYDDFYFKISGKRLVNGYTVITKDDKPV
NVNTMLPALSDFGLLYFCVLFLSKPYAKLFIDEVRLFEYSPFDDKENMIMSEMLSIYRIRTPRLHKIDSH
DSKATLAMDIFGELRRCPMELYNLLDKNAGPFFHDEVKHPNSHIPDVSKRLRYDDRFPTLALRYIDETE
LFKRIRFQLQLGSFRYKFYDKENCIDGRVRVRRIQKEINGYGRMQEKWDIQKREERSVKLE
HEELYINLDQFLEDTADSTPYVTDRRPAYNIHANRIGLYWEDSQNPKQYKVFDENGMYIPELVVIEDKKA
PIKMPAPRCALSVYDLPAMLFYEYLREQQDNEFPSAEQVIIEYEDDYRKFFKAVAEGKLKPFKRPKEFRD
FLKKEYPKLRMADIPKKLQLFLCSHGLCYNNKPETVYERLDRLTLQHLEERELHIQNRLEHYQKDRDMIG
NKDNQYGKKSFSDVRHGALARYLAQSMMEWQPTKLKDKEKGHDKLTGLNYNVLTAYLATYGHPQVPEEGF
TPRTLEQVLINAHLIGGSNPHPFINKVLALGNRNIEELYLHYLEEELKHIRSRIQSLSSNPSDKALSALP
FIHHDRMRYHERTSEEMMALAARYTTIQLPDGLFTPYILEILQKHYTENSDLQNALSQDVPVKLNPTCNA
AYLITLFYQTVLKDNAQPFYLSDKTYTRNKDGEKAESFSFKRAYELFSVLNNNKKDIFPFEMIPLFLTSD
EIQERLSAKLLDGDGNPVPEVGEKGKPATDSQGNTIWKRRIYSEDYDYAEKLTDRDMKISFKGEWEKLPR
WKQDKIIKRRDETRRQMRDELLQRMPRYIRDIKDNERTLRRYKTQDMVLFLLAEKMFTNIISEQSSEFNW
KQMRLSKVCNEAFLRQTLIFRVPVTVGETTIYVEQENMSLKNYGEFYRFLTDDRLMSLLNNIVETLKPNE
NGDLVIRHIDLMSELAAYDQYRSTIFMLIQSIENLIITNNAVLDDPDADGFWVREDLPKRNNFASLLELI
NQLNNVELTDDERKLLVAIRNAFSHSYNIDFSLIKDVKHLPEVAKGILQHLQSMLGVEITK
```

>gi|739060066|ref|WP_036931485.1| hypothetical protein [Prevotella pleuritidis] (SEQ ID NO: 102)
```
MENDKRLEESTCYTLNDKHFWAAFLNLARHNVYITINHINKLLEIRQIDNDEKVLDIKALWQKVDKDINQ
KARLRELMIKHFPFLEAAIYSNNKEDKEEVKEEKQAKAQSFKSLKDCLFLFLEKLQEARNYYSHYKSSES
SKEPEFEEGLLEKMYNTFGVSIRLVKEDYQYNKDIDPEKDFKHLERKEDFNYLFTDKDNKGKITKNGLLF
FVSLFLEKKDAIWMQQKLRGFKDNRGNKEKMTHEVFCRSRMLLPKIRLESTQTQDWILLDMLNELIRCPK
SLYERLQGAYREKFKVPFDSIDEDYDAEQEPFRNTLVRHQDRFPYFALRYFDYNEIFKNLRFQIDLGTYH
FSIYKKLIGDNKEDRHLTHKLYGFERIQEFAKQKRPNEWQALVKDLDIYETSNEQYISETTPHYHLENQK
IGIRFKNKKDKIWPSLEINGKENEKSKYNLDKSFQAEAFLSIHELLPMMFYDLLLKKEEPNNDEKNASIV
EGFIKKEIKRMYAIYDAFANEEINSKEGLEEYCKNKGFQERHLPKQMIAILINKSKNMAEKAKRKQKEMI
KDIKKRLAILDKQVKGEIEDGGRNIRLLKSGEIARWLVNDMMRFQSVQKDKEGKPLNNSKANSTEYQMLQ
RSLALYNKEQKPIPYFIQVNLIKSSNPHPFLEETKWEECNNILSFYRSYLEAKKNFLESLKFEDWKKNQY
FLMLKEPKTNRKTLVQGWKNGFNLPRGIFTEPIKEWFKRHQNDSEEYKKVEALDRVGLVAKVIPLFFKEE
YFKEDAQKEINNCVQPFYSFPYNVGNIHKPEENFLHCEERRKLWDKKKDKFKGYKAKEKSKKMTDKEKE
EHRSYLEFQSWNKFERELRLVRNQDIVTWLLCTELIDKLKIDELNIEELQKLRLKDIDTDTAKKEKNNIL
NRIMPMQLPVIVYEIDKSFNIVKDKPLHTIYIEEIGTKLLKQGNFKALVKDRRLNGLFSFVKISSEAESK
SKPISKLRVEYELGAYQKARIDIIKDMLALEKTLIDNDENLPINKFSDMLKSWLKGKGEANKARLQNDVD
LLVAIRNAFSHNQYPMYNSEVFKGMKLLSSSDIPEKEGLGIAKQLKDKIKETIERIIEIEKEIRN
```

>gi|746373271|ref|WP_039417390.1| hypothetical protein [Porphyromonas gingivalis] (SEQ ID NO: 103)

-continued

MTEQNERPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREGIVTEAGLLFFVSLFLEKRDAIWMQKKIRGFKGGTEAYQQMTNEVFCRSRISLP
KLKLESLRIDDWMLLDMLNELVRCPKSLYDRLREEDRARFRVPIDLSDEDDIDGTEEDPFKNILVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRLTAEAFLS
VHELMPMMFYYFLLREKYSEEVSAEKVQGRIKRVIEDVYAVYDAFARGEIDILDRLDACLADKGIRRGHL
PRQMIAILSQEHKDMEEKVRKKLQEMIADTDHRLDMLDRQTDRKIRIGRKNAGLPKSGVIADWLVRDMM
FQPVAKDTSGKPLNNSKANSTEYRMLQRALALFGGEKERLIPYFRQMNLIGGNNPHPFLHETRWESHINI
LSFYRSYLKARKAFLQSIGRSDREENHRFLLLKEPKTDRQTLVAGWKSEFHLPRGIFTEAVRDCLIEMGY
DEVGSYKEVGFMAKAVPLYFERACKDRVQPFYDYPFNVGNSLKPKKGRFLSKEKRAEEWESGKERFRLAK
LKKEILEAKEHPYLDFKSWQKFERELRLVKNQDIITWMMCRDLMEENKVEGLDIGTLYLKDIRTDVHEQG
SLNVLNRVKPMRLPVVVYRADSRGHVHKEQAPLATVYIEERDTKLLKQGNFKSFVKDRRLGLFSFVDTG
ALAMEQYPISKLRVEYELAKYQTARVCAFEQTLELEESLLTRYPHLPDKNFRKMLESWSDPLLDKWPDLH
RKVRLLIAVRNAFSHNQYPMYDEAVFSSIRKYDPSSPDAIEERMGLNIAHRLSEEVKQAKEMAERIIQV

>gi|746374939|ref|WP_039418912.1| hypothetical protein [Porphyromonas
gulae] (SEQ ID NO: 104)
MTEQSERPYNGTYYTLEDKHFWAAFLNLARHNAYITLTHIDRQLAYSKADITNDQDVLSFKALWKNLDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKRDHEHNDKVDPHRHFNHLVRKGKKDRY
GHNDNPSFKHHFVDSEGMVTEAGLLFFVSLFLEKRDAIWMQKKIRGFKGGTETYQQMTNEVFCRSRISLP
KLKLESLRMDDWMLLDMLNELVRCPKPLYDRLREDDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTSPHYHIEKGKIGLRFMPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIAILSQEHKNMEEKVRKKLQEMIADTDHRLDMLDRQTDRKIRIGRKNAGLPKSGVIADWLVRDMMR
FQPVAKDASGKPLNNSKANSTEYRMLQRALALFGGEKERLIPYFRQMNLIGGNNPHPFLHDTRWESHINI
LSFYRSYLRARKAFLPRGIGRSDRMENRPFLLLKEPKTDRQTLVAGWKSEFHLPRGIFTEAVRDCLIEMGY
DEVGSYREVGFMAKAVPLYFERACEDRVQPFYDSPFNVGNSLKPKKGRFLSKEERAEEWERGKERFRDLE
AWSHSAARRIEDAFAGIEYASPGNKKKIEQLLRDSLWEAFESKLKVRADKINLAKLKKEILEAQEHPYH
DFKSWQKFERELRLVKNQDIITWMMCRDLMEENKVEGLDIGTLYLKDIRTNVQEQGSLNVLNHVKPMRLP
VVVYRADSRGHVHKEEAPLATVYIEERDTKLLKQGNFKSFVKDRRLNGLFSFVDTGGLAMEQYPISKLRV
EYELAKYQTARVCAFEQTLELEESLLTRYPHLPDKNFRKMLESWSDPLLAKWPELHGKVRLLIAVRNAFS
HNQYPMYDEAVFSSIRKYDPSSPDAIEERMGLNIAHRLSEEVKQAKETVERIIQA >gi|746375986|ref|WP_039419792.1| hypothetical protein [Porphyromonas
gulae] (SEQ ID NO: 105)
MTEQSERPYNGTYYTLEDKHFWAAFLNLARHNAYITLTHIDRQLAYSKADITNDQDVLSFKALWKNLDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKRDHEHNDKVDPHRHFNHLVRKGKKDRY
GHNDNPSFKHHFVDGEGMVTEAGLLFFVSLFLEKRDAIWMQKKIRGFKGGTETYQQMTNEVFCRSRISLP
KLKLESLRIDDWMLLDMLNELVRCPKPLYDRLREKDRARFRVPVDILPDEDDIDGGGEDPFKNILVRHQD
RFPYFALRYFDLKKVFTSLRFHIDLGTYHFAIYKKVIGEQPEDRHLTRNLYGFGRIQDFAEEHRPEEWKR
LVRDLDYFETGDKPYISQTTPHYHIEKGKIGLRFVPEGQHLWPSPEVGITRTGRSKYAQDKRLTAEAFLS
VHELMPMMFYYFLLREKYSEEVSAEKVQGRIKRVIEDVYAIYDAFARDEINTRDELDACLADKGIRRGHL
PKQMIGILSQEHKNMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLDETRWESHINI
LSFYRSYLRARKAFLERIGRSDRVENRPFLLLKEPKTDRQTLVAGWKSEFHLPRGIFTEAVRDCLIEMGY
DEVGSYKEVGFMAKAVPLYFERACKDRVQPFYDSPFNVGNSLKPKKGRFLSKEKRAEEWESGKERFRLAK
LKKEILEAQEHPYHDFKSWQKFERELRLVKNQDIITWMMCRDLMEENKVEGLDIGTLYLKDIRPNVQEQG
SLNVLNRVKPMRLPVVVYRADSRGHVHKEEAPLATVYIEERDTKLLKQGNFKSFVKDRRLNGLFSFVDTG
GLAMEQYPISKLRVEYELAKYQTARVCVFELTLRLEESLLSRYPHLPDESFREMLESWSDPLLAKWPELH
GKVRLLIAVRNAFSHNQYPMYDEAVFSSIRKYDPSSPDAIEERMGLNIAHRLSEEVKQAKETVERIIQA >gi|746382772|ref|WP_039426176.1| hypothetical protein [Porphyromonas
gulae] (SEQ ID NO: 106)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSGSSELPLFDGNMLQRLYNVFDVSVQRVKRDHEHNDKVDPHYHFNHLVRKGKKDRY
GHNDNPSFKHHFVDSEGMVTEAGLFFVSLFLEKRDAIWMQKKIRGFKGGIGPYEQMTNEVFCRSRISLP
KLKLESLRIDDWMLLDMLNELVRCPKPLYDRLREKDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTTPHYHIEKGKIGLRFMPEGQHLWPSPEVGITRTGRSKYAQDKRLTAEAFLS
VHELMPMMFYYFLLREKYSEEVSAEKVQGRIKRVIKDVYAIYDAFARDEINTLKELDACSADKGIRRGHL
PKQMIGILSQEHKNMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLDETRWESHINI
LSFYRSYLRARKAFLERIGRSDRVENRPFLLLKEPKNDRQTLVAGWKSEFHLPRGIFTEAVRDCLIEMGY
DEVGSYKEVGFMAKAVPLYFERACKDRVQPFYDSPFNVGNSLKPKKGRFLSKEKRAEEWESGKERFRLAK
LKKEILEAKEHPYHDFKSWQKFERELRLVKNQDIITWMMCRDLMEENKVEGLDIGTLYLKDIRTDVHEQG
SLNVLNRVKPMRLPVVVYRADSRGHVHKEQAPLATVYIEERDTKLLKQGNFKSFVKDRRLNGLFSFVDTG
GLAMEQYPISKLRVEYELAKYQTARVCAFEQTLELEESLLTRYPHLPDENFREMLESWSDPLLGKWPDLH
GKVRLLIAVRNAFSHNQYPMYDEAVFSSIRKYDPSSPDAIEERMGLNIAHRLSEEVKQAKETVERIIQA >gi|746385904|ref|WP_039428968.1| hypothetical protein [Porphyromonas
sp. COT-052 OH4946] (SEQ ID NO: 107)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSESSELPLFDGNMLQRLYNVFDVSVQRVKRDHEHNDKVDPHRHFNHLVRKGKKDRY
GHNDNPSFKHHFVDSEGMVTEAGLLFFVSLFLEKRDAIWMQKKIRGFKGGTETYQQMTNEVFCRSRISLP -continued KLKLESLRIDDWMLLDMLNELVRCPKPLYDRLREDDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTTPHYHIEKGKIGLRFVPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIGILSQERKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLRARKAFLERIGRSDRVENCPFLLLKEPKTDRQTLVAGWKGEFHLPRGIFTEAVRDCLIEMGY
DEVGSYREVGFMAKAVPLYFERACEDRVQPFYDSPFNVGNSLKPKKGRFLSKEDRAEEWERGKERFRDLE
AWSHSAARRIKDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLRSYPHLPDESFREMLESWSDPLLAKWPELHGKVRLLIAVRNAFS
HNQYPMYDEAVFSSIRKYDPSSPDAIEERMGLNIAHRLSEEVKQAKETVERIIQA >gi|746388969|ref|WP_039431778.1| hypothetical protein [*Porphyromonas gulae*] (SEQ ID NO: 108)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNELIKKEKEELQANALSLDNLKSILFDFLQ
KLKDFRNYYSHYRHSESSELPLFDGNMLQRLYNVFDVSVQRVKRDHEHNDKVDPHRHFNHLVRKGKKDRY
GHNDNPSFKHHFVDGEGMVTEAGLLFFVSLFLEKRDAIWMQKKIRGFKGGTETYQQMTNEVFCRSRISLP
KLKLESLRIDDWMLLDMLNELVRCPKPLYDRLREDDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTSPHYHIEKGKIGLRFMPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIAILSQEHKDMEEKIRKKLQEMIADTDHRLDMLDRQTDRKIRIGRKNAGLPKSGVIADWLVRDMMR
FQPVAKDTSGKPLNNSKANSTEYRMLQRALALFGGEKKRLIPYFRQMNLIGGNNPHPFLHETRWESHINI
LSFYRSYLRARKAFLERIGRSDRMENRPFLLLKEPKTDRQTLVAGWKSEFHLPRGIFTEAVRDCLIEMGY
DEVGSYREVGFMAKAVPLYFERACEDRVQPFYDSPFNVGNSLKPKKGRFLSKEERAEEWERGKERFRDLE
AWSHSAARRIEDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLTRYPHLPDESFRKMLESWSDPLLAKWPELHGKVRLLIAVRNAFS
HNQYPMYDEAVFSSIRKYDPSSPDAIEERMGLNIAHRLSEEVKQAKETVERIIQV >gi|746392082|ref|WP_039434803.1| hypothetical protein [*Porphyromonas gulae*] (SEQ ID NO: 109)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNELIKKEKEELQANALSLDNLKSILFDFLQ
KLKDFRNYYSHYRHSGSSELPLFDGNMLQRLYNVFDVSVQRVKIDHEHNDEVDPHYHFNHLVRKGKKDRY
GHNDNPSFKHHFVDGEGMVTEAGLLFFVSLFLEKRDAIWMQKKIRGFKGGTETYQQMTNEVFCRSRISLP
KLKLESLRMDDWMLLDMLNELVRCPKPLYDRLREDDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTSPHYHIEKGKIGLRFMPEGQHLWPSPEVGITRTGRSKYAQDKRLTAEAFLS
VHELMPMMFYYFLLREKYSEEVSAERVQGRIKRVIEDVYAVYDAFARDEINTRDELDACLADKGIRRGHL
PRQMIAILSQEHKDMEEKIRKKLQEMMADTDHRLDMLDRQTDRKIRIGRKNAGLPKSGVIADWLVRDMMR
FQPVAKDASGKPLNNSKANSTEYRMLQRALALFGGEKERLIPYFRQMNLIGGNNPHPFLHETRWESHINI
LSFYRSYLRARKAFLERIGRSDRVENPFLLLKEPKTDRQTLVAGWKGEFHLPRGIFTEAVRDCLIEMGY
DEVASYKEVGFMAKAVPLYFERACEDRVQPFYDSPFNVGNSLKPKKGRFLSKEERAEEWERGKERFRDLE
AWSYSAARRIEDAFAGIEYASPGNKKKIEQLLRDLSLWEAFESKLKVRADRINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLTRYPHLPDESFREMLESWSDPLLAKWPELHGKVRLLIAVRNAFS
HNQYPMYDEAVFSSIRKYDPSSPDAIEERMGLNIAHRLSEEVKQAKETVERIIQA >gi|746399962|ref|WP_039442171.1| hypothetical protein [*Porphyromonas gulae*] (SEQ ID NO: 110)
MTEQSERPYNGTYYTLEDKHFWAAFLNLARHNAYITLTHIDRQLAYSKADITNDQDVLSFKALWKNLDND
LERKSRLRSLILKHFSFLEGAAYGKKLFESKSSGNKSSKNELIKKEKEELQANALSLDNLKSILFDFLQ
KLKDFRNYYSHYRHSGSSELPLFDGNMLQRLYNVFDVSVQRVKIDHEHNDKVDPHYHFNHLVRKGKKDRY
GHNDNPSFKHHFVDSEGMVTEAGLLFFVSLFLEKRDAIWMQKKIRGFKGGIGPYEQMTNEVFCRSRISLP
KLKLESLRIDDWMLLDMLNELVRCPKPLYDRLREKDRACFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYLETGDKPYISQTTPHYHIEKGKIGLRFVPEGQHLWPSPEVGITRTGRSKCAQDKRLTAEAFLS
VHELMPMMFYYFLLREKYSEEVSAEKVQGRIKRVIEDVYAIYDAFARDEINTLKELDTCLADKGIRRGHL
PKQMITILSQERKDMKEKIRKKLQEMIADTDHRLDMLDRQTDRKIRIGRKNAGLPKSGVIADWLVRDMMR
FQPVAKDASGKPLNNSKANSTEYRMLQRALALFGGEKERLIPYFRQMNLIGGNNPHPFLHETRWESHINI
LSFYRSYLRARKAFLERIGRSDRVENCPFLLLKEPKTDRQTLVAGWKDEFHLPRGIFTEAVRDCLIEMGY
DEVGSYREVGFMAKAVPLYFERACEDRVQPFYDSPFNVGNSLKPKKGRFLSKEDRAEEWERGMERFRDLE
AWSHSAARRIKDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEAPLATVYIEERNIKLLKQGNFKSFVKDRRLNGLFSFVDTGGLAMEQYPISKLRVE
YELAKYQTARVCVFELTLRLEESLLRSYPHLPDESFREMLESWSDPLLAKWPELHGKVRLLIAVRNAFSH
NQYPMYDEAVFSSIRKYDPSSPDAIEERMGLNIAHRLSEEVKQAKETVERIIQA >gi|746403165|ref|WP_039445055.1| hypothetical protein [*Porphyromonas gulae*] (SEQ ID NO: 111)
MNIVPATENKGQSRIVEDDPQYFGLYLNLARENLIEVESHVRIKFGKKKLNEESLKQSLLCDHLLSIDRW
TKVYGHSRRYLPFLHCFDPDSGIEKDHDSKTGVDPDSAQRLIRELYSLLDFLRNDFSHNRLDGITFEHLK
VSPDISSFITGAYTFACERAQSRFADFFKPDDFLLAKNRKEQLISVADGKECLIVSGFAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV -continued
```
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHDLRKLLLMELLCEGSFSRMQSDFLRKANRILDETAE
GKLQFSALFPEMRHRFIPPQNPKSKDRREKAETTLEKYKQEIKGRKDKLNSQLLSAPDMNQRQLPSRLLD
EWMNIRPASHSVKLRTYVKQLNEDCRLRLRKFRKDGDGKARAIPLVGEMATFLSQDIVRMIISEETKKLI
TSAYYNEMQRSLAQYAGEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVRDKKR
ELRTAGKPVPPDLAAYIKRSFHRAVNEREFMLRLVQEDDRLMLAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDHENRF
FGKLLNNMSQPINDL >gi|749365741|emb|CEN50095.1| conserved hypothetical protein
[Capnocytophaga canimorsus] (SEQ ID NO: 112)
MDEKPTIIKGKIFKGNEALFAHWFRYYKEYQNFQTFYDTENYPLVKLGKKQADRKRKTKIYQQKKNDVFT
LLMAKHIFKSVFKQDSIDRFSLEDLYQSREERLGNQERARQTGERNTNYIWNKTVDLKLCDGKITVENVK
LKNVGDFIKYEYDQRVQAFLTYEENIEWQAFLIKESKEEENYPYVVEREIEQYEKVRREELLKEVHLIEE
YILEKVKDKEILKKGDNQNFKYYILNGLLKQVKKEKEKEDVESYKVFNLNIKPEDVDINQLKQKAIDLEQ
KAFVLTYIRNKFAHNQLPKKFWDYCQEECGKIAKGKTYAEYFVEVFKREKEALMK >gi|749377015|emb|CEN32480.1| conserved hypothetical protein
[Capnocytophaga cynodegmi] (SEQ ID NO: 113)
MENKTSLGNNIYYNPFKPQDKSYFAGYLNAAMENIDSVFRELGKRLKGKEYISENFFDAIFKENISLVEY
ERYVKLLSDYFPMARLLDKKEVPIKERKENFKKNFRGIIKAVRDLRNFYTHKEHGEVEITDEIFGVLDEM
LKSTVLIVKKKKIKTDKIKEILKKSIEKQLDILCQKKLEYLKDTARKIEEKRRNQRERGEKKLVPRFEYS
DRRDDLIAAIYNDAFDVYIDKKKDSLKESSKTKYNTESYPQQEEGDLKIPISKNGVVFLLSLFLSKQEVH
APFKSKIAGFKATVIDEATVSHRKNSICFMATHEIFSHLAYKKLRKVRTAEINYSEAENAEQLSIYAKET
LMMQMLDELSKVPDVVYQNLSEDVQKTFIEDWNEYLKENNGDVGTMEEEQVIHPVIRKRYEDKFNYFAIR
FLDEFAQFPILRFQVHLGNYLHDSRPKEHLISDRRIKEKITVFGRLSELEHRKALFIKNTETNEDRKHYW
EVFPNPNYDFPKENISVNDKDFPIAGSILDREKQPIAGKIGIKVNLLNQKYISEVDKAVKAHQLKQRNNK
PSIQNIIEEIVPINGSNPKEIIVEGGQPTAYLSMNDIHSILYEFFDKWEKKKEKLEKKGEKELRKEIGKE
LEEKIVGKIQTQIQQIIDKDINAKILKPYQDDDSTAIDKEKLIKDLKQEQKILQKLKNEQTAREKEYQEC
IAYQEESRKIKRSDKSRQKYLRNQLKRKYPEVPIRKEILYYQEKGKVAVWLANDIKREMPTDFKNEWKGE
QHSLLQKSLAYYEQCKEELKNLLPQQKVFKHLPFELGGHFQQKYLYQFYTRYLDKRLEHISGLVQQAENF
KNENKVFKKVENECFKFLKKQNYTHKGLDAQAQSVLGYPIFLERGFMDEKPTIIKGKIFKGNESLFTDWF
RYYKEYQNFQTFYDTENYPLVELKKQADRKRETKIYQQKKNDVFILLMAKHIFKSVFKQDSIDRFSLED
LYQSREERLENQEKAKQTGERNTNYIWNKTVDLNLCDGKVIVENVKLKNVGNFIKYEYDQRVQTFLKYEE
NIKWQAFLIKESKEEENYPYIVEREIEQYEKVRREELLKEVHLIEEYILEKVKDKEILKKGDNQNFKYYI
LNGLLKQLKNEDVESYKVFNLNIKPEDVNINQLKQEATDLEQKAFVLTYIRNKFAHNQLPKKEFWDYCQE
KYGKIEKEKTYAEYFAEVFKREKEALMK >gi|754125679|ref|WP_041758328.1| hypothetical protein [Psychroflexus
torquis] (SEQ ID NO: 114)
MYVLNGLLIGIKQINIEDFIVLKQNINFDKIDFKGIASYSVLEKKTIILIAIRNKFAHNQLPNKIINDLA
NEFVKKEKNETYANYYLKVLKKMISDLA >gi|754596085|ref|WP_041986150.1| hypothetical protein [Capnocytophaga
canimorsus] (SEQ ID NO: 115)
MDEKPTIIKGKIFKGNEALFAHWFRYYKEYQNFQTFYDTENYPLVKLGKKQADRKRKTKIYQQKKNDVFT
LLMAKHIFKSVFKQDSIDRFSLEDLYQSREERLGNQERARQTGERNTNYIWNKTVDLKLCDGKITVENVK
LKNVGDFIKYEYDQRVQAFLTYEENIEWQAFLIKESKEEENYPYVVEREIEQYEKVRREELLKEVHLIEE
YILEKVKDKEILKKGDNQNFKYYILNGLLKQVKKEKEKEDVESYKVFNLNIKPEDVDINQLKQKAIDLEQ
KAFVLTYIRNKFAHNQLPKKFWDYCQEECGKIAKGKTYAEYFVEVFKREKEALMK >gi|754599669|ref|WP_041989581.1| hypothetical protein [Capnocytophaga
cynodegmi] (SEQ ID NO: 116)
MENKTSLGNNIYYNPFKPQDKSYFAGYLNAAMENIDSVFRELGKRLKGKEYISENFFDAIFKENISLVEY
ERYVKLLSDYFPMARLLDKKEVPIKERKENFKKNFRGIIKAVRDLRNFYTHKEHGEVEITDEIFGVLDEM
LKSTVLIVKKKKIKTDKIKEILKKSIEKQLDILCQKKLEYLKDTARKIEEKRRNQRERGEKKLVPRFEYS
DRRDDLIAAIYNDAFDVYIDKKKDSLKESSKTKYNTESYPQQEEGDLKIPISKNGVVFLLSLFLSKQEVH
APFKSKIAGFKATVIDEATVSHRKNSICFMATHEIFSHLAYKKLRKVRTAEINYSEAENAEQLSIYAKET
LMMQMLDELSKVPDVVYQNLSEDVQKTFIEDWNEYLKENNGDVGTMEEEQVIHPVIRKRYEDKFNYFAIR
FLDEFAQFPILRFQVHLGNYLHDSRPKEHLISDRRIKEKITVFGRLSELEHRKALFIKNTETNEDRKHYW
EVFPNPNYDFPKENISVNDKDFPIAGSILDREKQPIAGKIGIKVNLLNQKYISEVDKAVKAHQLKQRNNK
PSIQNIIEEIVPINGSNPKEIIVEGGQPTAYLSMNDIHSILYEFFDKWEKKKEKLEKKGEKELRKEIGKE
LEEKIVGKIQTQIQQIIDKDINAKILKPYQDDDSTAIDKEKLIKDLKQEQKILQKLKNEQTAREKEYQEC
IAYQEESRKIKRSDKSRQKYLRNQLKRKYPEVPIRKEILYYQEKGKVAVWLANDIKREMPTDFKNEWKGE
QHSLLQKSLAYYEQCKEELKNLLPQQKVFKHLPFELGGHFQQKYLYQFYTRYLDKRLEHISGLVQQAENF
KNENKVFKKVENECFKFLKKQNYTHKGLDAQAQSVLGYPIFLERGFMDEKPTIIKGKIFKGNESLFTDWF
RYYKEYQNFQTFYDTENYPLVELKKQADRKRETKIYQQKKNDVFILLMAKHIFKSVFKQDSIDRFSLED
LYQSREERLENQEKAKQTGERNTNYIWNKTVDLNLCDGKVIVENVKLKNVGNFIKYEYDQRVQTFLKYEE
NIKWQAFLIKESKEEENYPYIVEREIEQYEKVRREELLKEVHLIEEYILEKVKDKEILKKGDNQNFKYYI
LNGLLKQLKNEDVESYKVFNLNIKPEDVNINQLKQEATDLEQKAFVLTYIRNKFAHNQLPKKEFWDYCQE
KYGKIEKEKTYAEYFAEVFKREKEALMK >gi|755251047|gb|KIP58950.1| hypothetical protein ST43_06385
[Prevotella sp. P5-60] (SEQ ID NO: 117)
MNIPALVENQKKYFGTYSVMAMLNAQTVLDHIQKVADIEGEQNENNENLWFHPVMSHLYNAKNGYDKQPE
KTMFIIERLQSYFPFLKIMAENQREYSNGKYKQNRVEVNSNDIFEVLKRAFGVLKMYRDLINHYKTYEEK
LIDGCEFLTSTEQPFSGMISKYYTVALRNIKERYGYKAEDLAFIQDNRYKFTKDAYGKRKSQVNIGSFLS
```

```
LQDYNGDTIKKLHLSGVGIALLICFLDKQYINLFLSRLPIFSSYNAQSEERRIIIRSFGINSIKQPKDR
IHSEKSNKSVAMDMLNEVKRCPDELFTTLSAEKQSRFRIISDDHNEVLMKRSSDRFVPLLLQYIDYGKLF
DHIRFHVNMGKLRYLLKADKICIDGQTRVRVIEQPLNGFGRLEEVETMRKQENGTFGNSGIRIRDFENMK
RDDANPANYPYIVETYTHYILENNKVEMFISDEENPTPLLPVIEDDRYVVKTIPSCRMSTLEIPAMAFHM
FLFGSEKTEKLIIDVHDRYKRLFQAMQKEEVTAENIASFGIAESDLPQKIMDLISGNAHGKDVDAFIRLT
VDDMLIDTERRIKRFKDDRKSIRSADNKMGKRGFKQISIGKLADFLAKDIVLFQPSVNDGENKITGLNYR
IMQSAIAVYDSGDDYEAKQQFKLMFEKARLIGKGITEPHPFLYKVFVRSIPANAVDFYERYLIERKFYLI
GLSNEIKKGNRVDVPFIRRDQNKWKIPAMKTLGRIYSEDLPVELPRQMFDNEIKSHLKSLPQMEGIDFNN
ANVTYLIAEYMKRVLNDDFQTFYQWKRNYRYMDMLRGEYDRKGSLQHCFTSIEEREGLWKERASRTERYR
KLASNKIRSRNQMRNASSEEIETILDKRLSNCRNEYQKSEKIIRRYRVQDALLFLLAKKILTELADFDGE
RFKLKEIMPDAEKGILSEIMPMSFIFEKGGKIYTITSGGMKLKNYGDFFVLASDKRIGNLLELVGSNIVS
KEDIMEEFKKYDQCRPEISSIVFNLEKWAFDTYPELPARVDRKEKVDFWSILDVLSNNKDINNEQSYILR
KIRNAFDHNNYPDKGIVEIKALPEIAMSIKKAFGEYAIMK

>gi|755254328|gb|KIP62088.1| hypothetical protein ST45_06380
[Prevotella sp. P5-125] (SEQ ID NO: 118)
MNIPALVENQKKYFGTYSVMAMLNAQTVLDHIQKVADIEGEQNENNENLWFHPVMSHLYNAKNGYDKQPE
KTMFIIERLQSYFPFLKIMAENQREYSNGKYKQNRVEVNSNDIFEVLKRAFGVLKMYRDLINHYKTYEEK
LNDGCEFLTSTEQPLSGMINNYYTVALRNMNERYGYKTEDLAFIQDKRFKFVKDAYGKKKSQVNIGFFLS
LQDYNGDTQKKLHLSGVGIALLICFLDKQYINIFLSRLPIFSSYNAQSEERRIIRSFGINSIKLPKDR
IHSEKSNKSVAMDMLNEVKRCPDELFTTLSAEKQSRFRIISDDHNEVLMKRSSDRFVPLLLQYIDYGKLF
DHIRFHVNMGKLRYLLKADKICIDGQTRVRVIEQPLNGFGRLEEAETMRKQENGTFGNSGIRIRDFENMK
RDDANPANYPYIVDTYTHYILENNKVEMFINDKEDSAPLLPVIEDDRYVVKTIPSCRMSTLEIPAMAFHM
FLFGSKKTEKLIVDVHNRYKRLFQAMQKEEVTAENIASFGIAESDLPQKILDLISGNAHGKDVDAFIRLT
VDDMLIDTERRIKRFKDDRKSIRSADNKMGKRGFKQISIGKLADFLAKDIVLFQPSVNDGENKITGLNYR
IMQSAIAVYDSGDDYEAKQQFKLMFEKARLIGKGITEPHPFLYKVFARSIPANAVEFYERYLIERKFYLT
GLSNEIKKGNRVDVPFIRRDQNKWKIPAMKTLGRIYSEDLPVELPRQMFDNEIKSHLKSLPQMEGIDFNN
ANVTYLIAEYMKRVLDDDFQTFYQWNRNYRYMDMLKGEYDRKGSLQHCFTSVEEREGLWKERASRTERYR
KQASNKIRSNRQMRNASSEEIETILDKRLSNSRNEYQKSEKVIRRYRVQDALLFLLAKKILTELADFDGE
RFKLKEIMPDAEKGILSEIMPMSFIFEKGGKKYTITSEGMKLKNYGDFFVLASDKRIGNLLELVGSDIVS
KEDIMEEFNKYDQCRPEISSIVFNLEKWAFDTYPELSARVDREEKVDFKSILKILLNNKNINKEQSDILR
KIRNAFDHNNYPDKGVVEIKALPEIAMSIKKAFGEYAIMK >gi|755255649|gb|KIP63359.1| hypothetical protein ST44_03600
[Prevotella sp. P5-119] (SEQ ID NO: 119)
MNIPALVENQKKYFGTYSVMAMLNAQTVLDHIQKVADIEGEQNENNENLWFHPVMSHLYNAKNGYDKQPE
KTMFIIERLQSYFPFLKIMAENQREYSNGKYKQNRVEVNSNDIFEVLKRAFGVLKMYRDLINHYKTYEEK
LIDGCEFLTSTEQPLSGMISKYYTVALRNIKERYGYKTEDLAFIQDNIKKITKDAYGKRKSQVNIGFFLS
LQDYNGDTQKKLHLSGVGIALLICFLDKQYINIFLSRLPIFSSYNAQSEERRIIIRSFGINSIKLPKDR
IHSEKSNKSVAMDMLNEVKRCPDELFTTLSAEKQSRFRIISDDHNEVLMKRSTDRFVPLLLQYIDYGKLF
DHIRFHVNMGKLRYLLKADKICIDGQTRVRVIEQPLNGFGRLEEAETMRKQENGTFGNSGIRIRDFENVK
RDDANPANYPYIVDTYTHYILENNKVEMFISDKGSSAPLLPLIEDDRYVVKTIPSCRMSTLEIPAMAFHM
FLFGSKKTEKLIVDVHNRYKRLFQAMQKEEVTAENIASFGIAESDLPQKILDLISGNAHGKDVDAFIRLT
VDDMLIDTERRIKRFKDDRKSIRSADNKMGKRGFKQISIGKLADFLAKDIVLFQPSVNDGENKITGLNYR
IMQSAIAVYDSGDDYEAKQQFKLMFEKARLIGKGITEPHPFLYKVFARSIPANAVDFYERYLIERKFYLT
GLCNEIKRGNRVDVPFIRRDQNKWKIPAMKTLGRIYSEDLPVELPRQMFDNEIKSHLKSLPQMEGIDFNN
ANVTYLIAEYMKRVLNDDFQTFYQWKRNYHYMDMLKGEYDRKGSLQHCFTSVEEREGLWKERASRTERYR
KLASNKIRSNRQMRNASSEEIETILDKRLSNCRNEYQKSEKVIRRYRVQDALLFLLAKKILTELADFDGE
RFKLKEIMPDAEKGILSEIMPMSFIFEKGGKKYTITSEGMKLKNYGDFFVLASDKRIGNLLELVGSDIVS
KEDIMEEFNKYDQCRPEISSIVFNLEKWAFDTYPELSARVDREEKVDFKSILKILLNNKNINKEQSDILR
KIRNAFDHNNYPDKGIVEIKALPEIAMSIKKAFGEYAIMK >gi|755581756|ref|WP_042518169.1| hypothetical protein [Prevotella sp.
P5-119] (SEQ ID NO: 120)
MNIPALVENQKKYFGTYSVMAMLNAQTVLDHIQKVADIEGEQNENNENLWFHPVMSHLYNAKNGYDKQPE
KTMFIIERLQSYFPFLKIMAENQREYSNGKYKQNRVEVNSNDIFEVLKRAFGVLKMYRDLINHYKTYEEK
LIDGCEFLTSTEQPLSGMISKYYTVALRNIKERYGYKTEDLAFIQDNIKKITKDAYGKRKSQVNIGFFLS
LQDYNGDTQKKLHLSGVGIALLICFLDKQYINIFLSRLPIFSSYNAQSEERRIIIRSFGINSIKLPKDR
IHSEKSNKSVAMDMLNEVKRCPDELFTTLSAEKQSRFRIISDDHNEVLMKRSTDRFVPLLLQYIDYGKLF
DHIRFHVNMGKLRYLLKADKICIDGQTRVRVIEQPLNGFGRLEEAETMRKQENGTFGNSGIRIRDFENVK
RDDANPANYPYIVDTYTHYILENNKVEMFISDKGSSAPLLPLIEDDRYVVKTIPSCRMSTLEIPAMAFHM
FLFGSKKTEKLIVDVHNRYKRLFQAMQKEEVTAENIASFGIAESDLPQKILDLISGNAHGKDVDAFIRLT
VDDMLIDTERRIKRFKDDRKSIRSADNKMGKRGFKQISIGKLADFLAKDIVLFQPSVNDGENKITGLNYR
IMQSAIAVYDSGDDYEAKQQFKLMFEKARLIGKGITEPHPFLYKVFARSIPANAVDFYERYLIERKFYLT
GLCNEIKRGNRVDVPFIRRDQNKWKIPAMKTLGRIYSEDLPVELPRQMFDNEIKSHLKSLPQMEGIDFNN
ANVTYLIAEYMKRVLNDDFQTFYQWKRNYHYMDMLKGEYDRKGSLQHCFTSVEEREGLWKERASRTERYR
KLASNKIRSNRQMRNASSEEIETILDKRLSNCRNEYQKSEKVIRRYRVQDALLFLLAKKILTELADFDGE
RFKLKEIMPDAEKGILSEIMPMSFIFEKGGKKYTITSEGMKLKNYGDFFVLASDKRIGNLLELVGSDIVS
KEDIMEEFNKYDQCRPEISSIVFNLEKWAFDTYPELSARVDREEKVDFKSILKILLNNKNINKEQSDILR
KIRNAFDHNNYPDKGIVEIKALPEIAMSIKKAFGEYAIMK >gi|762997475|ref|WP_043894148.1| hypothetical protein [Porphyromonas
gingivalis] (SEQ ID NO: 121)
MTEQNEKPYNGTYYTLEDKHFWAAFFNLARHNAYITLTHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRC
GNNDNPFFKHHFVDREGKVTEAGLLFFVSLFLEKRDAIWMQKKIRGFKGGTETYQQMTNEVFCRSRISLP
KLKLESLRIDDWMLLDMLNELVRCPKSLYDRLREEDRACFRVPVDILSDEDDIDGAEEDPFKNILVRHQD
RFPYFALRYFDLKKVFTSLRFHIDLGTYHFAIYKKNIGEQPEDRHLTRNLYGFGRIQDFAEEHRPEEWKR
LVRDLDCFETGDKPYITQTTPHYHIEKGKIGLRFVPEGQHLWPSPEVGATRTGRSKYAQDKRLTAEAFLS
VHELMPMMFYYFLLREKYSDEASAERVQGRIKRVIEDVYAVYDAFARGEIDILDRLDACLADKGIRRGHL
```

-continued
PRQIIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDRVENHRFLLLKEPKTDRQTLVAGWKGEFHLPRGIFTEAVRDCLIEMGH
DEVASYKEVGFMAKAVPLYFERACKDRVQPFYDYPFNVGNSLKPKKGRFLSKEKRAEEWESGKERFRDLE
AWSHSAARRIEDAFVGIEYASWENKKKIEQLLQDLSLWETFESKLKVKADKINIAKLKKEILEAKEHPYH
DFKSWQKFERELRLVKNQDIITWMMCRDLMEENKVEGLDIGTLYLKDIRTDVHEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCAFEQTLELEESLLTRYPHLPDKNFRKMLESWSDPLLDKWPDLHRKVRLLIAVRNAFS
HNQYPMYDEAVFSSIRKYDPSSLDAIEERMGLNIAHRLSEEVKQAKETVERIIQA >gi|762999449|ref|WP_043894372.1| hypothetical protein [Porphyromonas
gingivalis] (SEQ ID NO: 122)
MTEQNERPYNGTYYTLEDKHFWAAFLNLARHNAYITLTHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREGIVTEAGLLFFVSLFLEKRDAIWMQKKIRGFKGGTETYQQMINEVFCRSRISLP
KLKLESLRIDDWMLLDMLNELVRCPKSLYDRLCEEDRACFRVPVDILSDEDDIDGAEEDPFKNILVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRLTAEAFLS
VHELMPMMFYYFLLREKYSDEASAERVQGRIKRVIEDVYAVYDAFARGEIDILDRLDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDRVENHRFLLLKEPKTDRQTLVAGWKSEFHLPRGIFTEAVRDCLIEMGH
DEVGSYKEVGFMAKAVPLYFERACKDRVQPFYDYPFNVGNSLKPKKGRFLSKEDRAEEWESGKERFRLAK
LKKEILEAKEHPYLDFKSWQKFERELRLVKNQDIITWMMCRDLMEENKVEGLDIGTLYLKDIRTDVYEQG
SLNVLNRVKPMRLPVVVYRADSRGHVHKEQAPLATVYIEERDTKLLKQGNFKSFVKDRRLNGLFSFVDTG
GLAMEQYPISKLRVEYELAKYQTARVCAFEQTLELEESLLTRYPHLPDESFREMLESWSDPLLDKWPDLH
RKVRLLIAVRNAFSHNQYPMYDEAVFSSIRKYDPSSPDAIEERMGLNIAHRLSEEVKQAKEMAERIIQA >gi|763000465|ref|WP_043894537.1| hypothetical protein [Porphyromonas
gingivalis] (SEQ ID NO: 123)
MTEQNERPYNGTYYTLEDKHFWAAFLNLARHNAYITLTHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREEKVTEAGLLFFVSLFLEKRDAIWMQKKIRGFKGGTETYQQMTNEVFCRSRISLP
KLKLESLRTDDWMLLDMLNELVRCPKSLYDRLREEDRARFRVPIDILSDEDDTDGAEEDPFKNTLVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRLTAEAFLS
VHELMPMMFYYFLLREKYSEEASAERVQGRIKRVIEDVYAVYDAFARGEIDTLDRLDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLTPYFRQMNLTGGNNPHPFLHETRWESHTNI
LSFYRSYLKARKAFLQSIGRSDREENHRFLLLKEPKTDRQTLVAGWKSEFHLPRGIFTEAVRDCLIEMGL
DEVGSYKEVGFMAKAVPLYFERACKDRVQPFYNYPFNVGNILKPKKGRFLSKEKRAEEWESGKERFRDLE
AWSQSTARRIEDAFAGIKYASPGNKKKIEQLLQDSLWETFESKLKVKADKINLAKLKKEILEAKEHPYL
DFKSWQKFERELRLVKNQDIITWMMCRDLMEENKVEGLDTGTLYLKDIRTDVQEQGSLNVLNHVKPMRLP
VVVYRADSRGHVHKEEAPLATVYIEERDTKLLKQGNFKSFVKDRRLNGLFSFVDTGALAMEQYPISKLRV
EYELAKYQTARVCAFEQTLELEESLLTRYPHLPDKNFRKMLESWSDPLLDKWPDLHRKVRLLIAVRNAFS
HNQYPMYDEAVFSSIRKYDPSSPDAIEERMGLNIAHRLSEEVKQAKETVERIIQA >gi|763001609|ref|WP_043894751.1| hypothetical protein [Porphyromonas
gingivalis] (SEQ ID NO: 124)
MTEQNERPYNGTYYTLEDKHFWAAFLNLARHNAYITLAHIDRQLAYSKADITNDEDILFFKGQWKNLDND
LERKARLRSLILKHFSFLEGAAYGKKLFESQSSGNKSSKKKELTKKEKEELQANALSLDNLKSILFDFLQ
KLKDFRNYYSHYRHPESSELPLFDGNMLQRLYNVFDVSVQRVKRDHEHNDKVDPHRHFNHLVRKGKKDRY
GNNDNPFFKHHFVDREGTVTEAGLLFFVSLFLEKRDAIWMQKKIRGFKGGTETYQQMTNEVFCRSRISLP
KLKLESLRTDDWMLLDMLNELVRCPKSLYDRLREEDRARFRVPVDILSDEDDTDGTEEDPFKNTLVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRFTAEAFLS
VHELMPMMFYYFLLRENYSDEASAERVQGRIKRVIEDVYAVYDAFARGEIDTLDRLDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLTPYFRQMNLTGGNNPHPFLHETRWESHTNI
LSFYRSYLKARKAFLQSIGRSDRVENHRFLLLKEPKTDRQTLVAGWKGEFHLPRGIFTEAARDCLIEMGH
DEVASYKEVGFMAKAVPLYFERACKDRVQPFYDYPFNVGNSLKPKKGRFLSKEKRAEEWESGKERFRLAK
LKKEILEAKEHPYLDFKSWQKFERELRLVKNQDIITWMMCRDLMEENKVEGLDTGTLYLKDIRTDVQEQG
SLNVLNRVKPMRLPVVVYRADSRGHVHKEQAPLATVYIEERDTKLLKQGNFKSFVKDRRLNGLFSFVDTG
ALAMEQYPISKLRVEYELAKYQTARVCAFEQTLELEESLLTRYPHLPDKSFREMLESWSDPLLDKWPDLH
RKVRLLIAVRNAFSHNQYPMYDEAVFSSIRKYDPSSLDAIEERMGLNIAHRLSEEVKQAKEMVERIIQV >gi|763003511|ref|WP_043895240.1| hypothetical protein [Porphyromonas
gingivalis] (SEQ ID NO: 125)
MTEQNEKPYNGTYYTLEDKHFWAAFFNLARHNAYITLTHIDRQLAYSKADITNDEDILFFKGQWKNLDND
LERKARLRSLILKHFSFLEGAAYGKKLFESQSSGNKSSKKKELTKKEKEELQANALSLDNLKSILFDFLQ
KLKDFRNYYSHYRHPESSELPLFDGNMLQRLYNVFDVSVQRVKRDHEHNDKVDTHRHFNHLVRKGKKDRY
GNNDNPFFKHHFVDREGTVTEAGLLFFVSLFLEKRDAIWMQKKIRGFKGGTETYQQMTNEVFCRSRISLP
KLKLESLRTDDWMLLDMLNELVRCPKSLYDRLREEDRARFRVPVDILSDEDDTDGAEEDPFKNTLVRHQD
RFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQHLWPSPEVGATRTGRSKYAQDKRLTAEAFLS
VHELMPMMFYYFLLREKYSEEASAERVQGRIKRVIEDVYAVYDAFARGEIDTLDRLDACLADKGIRRGHL
PRQMIAILSQEHKDMEEKIRKKLQEMMADTDHRLDMLDRQTDRKIRIGRKNAGLPKSGVIADWLVRDMMR
FQPVAKDTSGKPLNNSKANSTEYRMLQRALALFGGEKERLTPYFRQMNLTGGNNPHPFLHETRWESHTNI
LSFYRSYLKARKAFLQSIGRSDRVENHRFLLLKEPKTDRQTLVAGWKGEFHLPRGIFTEAVRDCLIEMGH -continued
DEVASYKEVGFMAKAVPLYFERACKDRVQPFYDYPFNVGNSLKPKKGRFLSKEKRAEEWESGKERFRDLE
AWSQSAVRRIEDAFAGIENASRENKKKIEQLLQDLSLWKAFESKLKVRGDKINIAKLKKEILEAKEHPYH
DFKSWQKFERELRLVKNQDIITWMMCRDLMEENKVEGLDTGTLYLKDIRTDVHEQGSLNVLNRVKPMRLP
VVVYRADSRGHVHKEQAPLATVYIEERDTKLLKQGNFKSFVKDRRLNGLFSFVDTGALAMEQYPISKLRV
EYELAKYQTARVCAFEQTLELEESLLTRCPHLPDKNFRKMLESWSDPLLDKWPDLHRKVRLLIAVRNAFS
HNQYPMYDEAVFSSIRKYDPSSPDAIEERMGLNIAHRLSEEVKQAKETVERIIQA >gi|763006464|ref|WP_043895933.1| hypothetical protein [*Porphyromonas gingivalis*] (SEQ ID NO: 126)
MTEQNERPYNGTYYTLEDKHFWAAFLNLARHNAYITLTHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDSVQRVKRDHEHNDKVDPHRHFNHLVRKGKKDKY
GNNDNPFFKHHFVDREETVTEAGLLFFVSLFLEKRDAIWMQKKIRGFKGGTETYQQMTNEVFYRSRISLP
KLKLESLRIDDWMLLDMLNELVRCPKSLYDRLREEDRACFRVPVDILSDEDDIDGAEEDPFKNILVRHQD
RFPYFALRYFDLKKVFTSLRFHIDLGTYHFAIYKKNIGEQPEDRHLTRNLYGFGRIQDFAEEHRPEEWKR
LVRDLDCFETGDKPYITQTTPHYHIEKGKIGLRFVPEGQHLWPSPEVGATRTGRSKYAQDKRLTAEAFLS
VHELMPMMFYYFLLREKYSDEASAERVQGRIKRVIEDVYAVYDAFARGEIDILDRLDACLADKGIRRGHL
PRQIIAILSQEHKDMEEKVRKKLQEMIADTDHRLDMLDRQTDRKIRIDRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDRVENHRFLLLKEPKTDRQTLVAGWKGEFHLPRGIFTEAVRDCLIEMGL
DEVGSYKEVGFMAKAVPLYFERACKDRVQPFYNYPFNVGNILKPKKGRFLSKEKRAEEWESGKERFRDLE
AWSQSTARRIEDAFAGIKYASPGNKKKIEQLLQDLSLWETFESKLKVKADKINLAKLKKEILEAKEHPYL
DFKSWQKFERELRLVKNQDIITWMMCRDLMEENKVEGLDIGTLYLKDIWTDVHEQGSLNVLNRVKPMRLP
VVVYRADSRGHVHKEQAPLATVYIEERDTKLLKQGNFKSFVKDRRLNGLFSFVDTGGLAMEQYPISKLRV
EYELAKYQTARVCAFEQTLELEESLLTRCPHLPDKNFRKMLESWSDPLLDKWPDLHRKVRLLIAVRNAFS
HNQYPMYDEAVFSSIRKYDPSSPDAIEERMGLNIAHRLSEEVKQAKEMAERIIQA >gi|763187618|ref|WP_044065294.1| hypothetical protein [*Prevotella* sp. P5-125] (SEQ ID NO: 127)
MNIPALVENQKKYFGTYSVMAMLNAQTVLDHIQKVADIEGEQNENNENLWFHPVMSHLYNAKNGYDKQPE
KTMFIIERLQSYFPFLKIMAENQREYSNGKYKQNRVEVNSNDIFEVLKRAFGVLKMYRDLINHYKTYEEK
LNDGCEFLTSTEQPLSGMINNYYTVALRNMNERYGYKTEDLAFIQDKRFKFVKDAYGKKKSQVNIGFFLS
LQDYNGDTQKKLHLSGVGIALLICLFLDKQYINIFLSRLPIFSSYNAQSEERRIIIRSFGINSIKLPKDR
IHSEKSNKSVAMDMLNEVKRCPDELFTTLSAEKQSRFRIISDDHNEVLMKRSSDRFVPLLLQYIDYGKLF
DHIRFHVNMGKLRYLLKADKICIDGQTRVRVIEQPLNGFGRLEEAETMRKQENGTFGNSGIRIRDFENMK
RDDANPANYPYIVDTYTHYILENNKVEMFINDKEDSAPLLPVIEDDRYVVKTIPSCRMSTLEIPAMAFHM
FLFGSKKTEKLIVDVHNRYKRLFQAMQKEEVTAENIASFGIAESDLPQKILDLISGNAHGKDVDAFIRLT
VDDMLIDTERRIKRFKDDRKSIRSADNKMGKRGFKQISIGKLADFLAKDIVLFQPSVNDGENKITGLNYR
IMQSAIAVYDSGDDYEAKQQFKLMFEKARLIGKGITEPHPFLYKVFARSIPANAVEFYERYLIERKFYLT
GLSNEIKKGNRVDVPFIRRDQNKWKIPAMKTLGRIYSEDLPVELPRQMFDNEIKSHLKSLPQMEGIDFNN
ANVTYLIAEYMKRVLDDDFQTFYQWNRNYRYMDMLKGEYDRKGSLQHCFTSVEEREGLWKERASRTERYR
KQASNKIRSNRQMRNASSEEIETILDKRLSNSRNEYQKSEKVIRRYRVQDALLFLLAKKILTELADFDGE
RFKLKEIMPDAEKGILSEIMPMSFIFEKGGKKYTITSEGMKLKNYGDFFVLASDKRIGNLLELVGSDIVS
KEDIMEEFNKYDQCRPEISSIVFNLEKWAFDTYPELSARVDREEKVDFKSILKILLNNKNINKEQSDILR
KIRNAFDHNNYPDKGVVEIKALPEIAMSIKKAFGEYAIMK >gi|763200485|ref|WP_044074780.1| hypothetical protein [*Prevotella* sp. P5-60] (SEQ ID NO: 128)
MNIPALVENQKKYFGTYSVMAMLNAQTVLDHIQKVADIEGEQNENNENLWFHPVMSHLYNAKNGYDKQPE
KTMFIIERLQSYFPFLKIMAENQREYSNGKYKQNRVEVNSNDIFEVLKRAFGVLKMYRDLINHYKTYEEK
LIDGCEFLTSTEQPFSGMISKYYTVALRNIKERYGYKAEDLAFIQDNRYKFTKDAYGKRKSQVNIGSFLS
LQDYNGDTIKKLHLSGVGIALLICLFLDKQYINLFLSRLPIFSSYNAQSEERRIIIRSFGINSIKQPKDR
IHSEKSNKSVAMDMLNEVKRCPDELFTTLSAEKQSRFRIISDDHNEVLMKRSSDRFVPLLLQYIDYGKLF
DHIRFHVNMGKLRYLLKADKICIDGQTRVRVIEQPLNGFGRLEEVETMRKQENGTFGNSGIRIRDFENMK
RDDANPANYPYIVETYTHYILENNKVEMFISDEENPTPLLPVIEDDRYVVKTIPSCRMSTLEIPAMAFHM
FLFGSEKTEKLIIDVHDRYKRLFQAMQKEEVTAENIASFGIAESDLPQKIMDLISGNAHGKDVDAFIRLT
VDDMLIDTERRIKRFKDDRKSIRSADNKMGKRGFKQISIGKLADFLAKDIVLFQPSVNDGENKITGLNYR
IMQSAIAVYDSGDDYEAKQQFKLMFEKARLIGKGITEPHPFLYKVFVRSIPANAVDFYERYLIERKFYLI
GLSNEIKKGNRVDVPFIRRDQNKWKIPAMKTLGRIYSEDLPVELPRQMFDNEIKSHLKSLPQMEGIDFNN
ANVTYLIAEYMKRVLNDDFQTFYQWKRNYRYMDMLRGEYDRKGSLQHCFTSIEEREGLWKERASRTERYR
KLASNKIRSNRQMRNASSEEIETILDKRLSNCRNEYQKSEKIIRRYRVQDALLFLLAKKILTELADFDGE
RFKLKEIMPDAEKGILSEIMPMSFIFEKGGKIYTITSGGMKLKNYGDFFVLASDKRIGNLLELVGSNIVS
KEDIMEEFKKYDQCRPEISSIVFNLEKWAFDTYPELPARVDRKEKVDFWSILDVLSNNKDINNEQSYILR
KIRNAFDHNNYPDKGIVEIKALPEIAMSIKKAFGEYAIMK >gi|763360704|ref|WP_044218239.1| hypothetical protein [*Phaeodactylibacter xiamenensis*] (SEQ ID NO: 129)
MINTPKRRILHRHPSYFGAFLNIARHNAFMIMEHLSTKYDMEDILNDEAQLPNAKLFGCLKKRYGKPDV
TEGVSRDLRRYFPFLNYPLFHLEKQQNAEQAATYDINPEDIEFILKGFFRLLNQMRNNYSHYISNIDYG
KFDKLPVQDIYEAAIFRLLDRGKHTKRFDVFESKHIRHLESNNSEYRPRSLANSPDHENTVAFVTCLFLE
RKYAFPFLSRLDCFRSINDAAEGDPLIRKASHECYTMFCCRLPQPKLESSDILLDMVNELGRCPSALYNL
LSEEDQARFHIKREEITGFEEDPDEELEQEIVLKRHSDRFPYFALRYFDDTEAFQTLRFDVYLGRWRIKP
VYKKRIYGQERDRVLIQSIRTFIRLSRLLPIYENVKHDAVRQNEEDGKLVNPDVISQFHKSWIQIESDDR
AFLSDRIEHFSPHYNFGDQVIGLKFINPDRYAAIQNVFPKLPGEEKKDKDAKLVNETADAIISTHEIRSL
FLYHYLSKKPISAGDERRFIQVDTETFIKQYIDTIKLFFEDIKSGELQPIADPPNYQKNEPLPYVRGDKE
KTQEERAQYREROKEIKERRKELNILLQNRYGLSIQYIPSRLREYLLGYKKVPYEKLALQKLRAQRKEVK
KRIDIEKMRTPRVGEQATWLAEDIVFLIPPKMHIPERKTIKHPQKLNNDQFRIMQSSLAYFSVNKKAIK
KFFQKETGIGLSNRETSHPFLYRIDVGRCRGILDFYIGYLKKMDWLDDAIKKVDNRKHGKKEAKKYEKY
LPSSIQHKTPLELDYIRLPVYLPRGLFKKAIVKALAAHADFQVEPEEDNVIFCLDQLLDGDTQDFYNWQR
YYRSALTEKEIDNQLVLAHPYAEQILGTIKTLEGKQKNNKLGNKAKQKIKDELIDLKRAKRRLLDREQYL
RAVQAEDRALWLMIQERQKQKAEHEEIAFDQLDLKNITKILTESIDARLRIPDTKVDITDKLPLRRYGDL -continued RRVAKDRRLVNLASYYHVAGLSEIPYDLVKKELEEYDRRRVAFFEHVYQFEKEVYDRYAAELRNENPKGE
STYFSHWEYVAVAVKHSADTHFNELFKEKVMQLRNKFHHNEFPYFDWLLPEVEKASAALYADRVFDVAEG
YYQKMRKLMRQ >gi|769827477|gb|KJJ86756.1| hypothetical protein M573_117042
[*Prevotella intermedia* ZT] (SEQ ID NO: 130)
MKMEDDKKITESTNMLDNKHFWAAFLNLARHNVYITVNHINKVLELKNKKDQDIIIDNDQDILAIKTHWE
KVNGDLNKTERLRELMTKHFPFLETAIYIKNKEDKEEVKQEKQAEAQSLESLKDCLFLFLEKLQEARNYY
SHYKYSESTKEPMLEEGLLEKMYNIFDDNIQLVIKDYQHNKDINPDEDFKHLDRKGQFKYSFADNEGNIT
ESGLLFFVSLFLEKKDAIWMQQKLIGFKDNRESKKKMTHEVFCRRRMLLPKLRLESTQTQDWILLDMLNE
LIRCPKSLYERLQGEYRKKENVPFDSADEDYDAEQEPFKNILVRHQDRFPYFALRYFDYNEIFTNLRFQI
DLGTYHFSIYKKLIGGQKEDRHLTHKLYGFERIQEFAKQNRPDEWKALVKDLDIYETSNERYISETTPHY
HLENQKIGIRFRNGNKEIWPSLKINGENNEKSKYKLDKPYQAEAFLSVHELLPMMFYYLLLKKEEPNNDK
KNASIVEGFIKREIRDMYKLYDAFANGEINNIGDLEKYCEDKGIPKRHLPKQMVAILYDEPKDMVKEAKR
KQKEMVKDIKKLLATLEKQTQEEIEDGGRNIRLLKSGEIARWLVNDMMRFQPVQKDNEGNPLNNSKANST
EYQMLQRSLALYNKEEKPTRYFRQVNLINSSNPHPFLKWIKWEECNNILSFYRNYLIKKIEFLNKLKPED
WEKNQYFLKLKEPKTNRETLVQGWKNGFNLPRGIFTEPIREWFKRHQNDSKEYEKVEALKRVGLVTKVIP
LFFKEEYFKEDAQKEINNCVQPFYSFPYNVGNIHKPDEKDFLPSEERKKLWGDKKDKFKGYKAKVKSKKL
TDKEKEEYRSYLEFQSWNKFERELRLVRNQDIVTWLLCTELIDKMKVEGLNVEELQKLRLKDIDTDTAKQ
EKNNILNRIMPMQLPVIVYEIDDSHNIVKDRPLHIVYIEETKIKLLKQGNFKALVKDRRLNGLFSFVDTS
SKAELKDKPISKSVVEYELGEYQNARIETIKDMLLLEKTLIKKYEKLPIDNFSDMLNGWLEGKDESDKAR
FQNDVKLLVAVRNAFSHNQYPMRNRIAFANINPFSLSSADISEEKKLDIANQLKDKIHKIIKKIIEIEKP
IETKE >gi|806787645|gb|KKC50278.1| hypothetical protein HR1010685
[*Porphyromonas gulae*] (SEQ ID NO: 131)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSESSELPLFDGNMLQRLYNVFDVSVQRVKRDHEHNDKVDPHRHFNHLVRKGKKDRY
GHNDNPSFKHHFVDSEGMVTEAGLLFVSLFLEKRDAIWMQKKIRGFKGGTETYQQMTNEVFCRSRISLP
KLKLESLRIDDWMLLDMLNELVRCPKPLYDRLREKDRARFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTTPHYHIEKGKIGLRFMPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIAILSQEHKDMEEKIRKKLQEMIADTDHRLDMLDRQTDRKIRIGRKNAGLPKSGVIADWLVRDMMR
FQPVAKDTSGKPLNNSKANSTEYRMLQRALALFGGEKKRLIPYFRQMNIGGNNPHPFLHETRWESHINI
LSFYRSYLRARKAFLERIGRSDRMENRPFLLLKEPKTDRQTLVAGWKSEFHLPRGIFTEAVRDCLIEMGY
DEVGSYREVGFMAKAVPLYFERACEDRVQPFYDSPFNVGNSLKPKKGRFLSKEERAEEWERGKERFRDLE
AWSHSAARRIEDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLTRYPHLPDESFRKMLESWSDPLLAKWPELHGKVRLLIAVRNAFS
HNQYPMYDEAVFSSIRKYDPSSPDAIEERMGLNIAHRLSEEVKQAKETVERIIQV >gi|807048513|ref|WP 046201018.1| hypothetical protein [*Porphyromonas gulae*] (SEQ ID NO: 132)
MTEQSERPYNGTYYTLEDKHFWAAFLNLARHNAYITLTHIDRQLAYSKADITNDQDVLSFKALWKNFDND
LERKSRLRSLILKHFSFLEGAAYGKKLFESKSSGNKSSKNKELIKKEKEELQANALSLDNLKSILFDFLQ
KLKDFRNYYSHYRHSESSELPLFDGNMLQRLYNVFDVSVQRVKRDHEHNDKVDPHRHFNHLVRKGKKDRY
GHNDNPSFKHHFVDSEGMVTEAGLLFFVSLFLEKRDAIWMQKKIRGFKGGTETYQQMTNEVFCRSRISLP
KLKLESLRIDDWMLLDMLNELVRCPKPLYDRLREKDRARFRVPVDILPDEDDIDGGGEDPFKNILVRHQD
RFPYFALRYFDLKKVFTSLRFHIDLGTYHFAIYKKMIGEQPEDRHLTRNLYGFGRIQDFAEEHRPEEWKR
LVRDLDYFETGDKPYISQTTPHYHIEKGKIGLRFMPEGQHLWPSPEVGITRTGRSKYAQDKRLTAEAFLS
VHELMPMMFYYFLLREKYSEEVSAEKVQGRIKRVIEDVYAIYDAFARDEINTLKELDACLADKGIRRGHL
PKQMIAILSQEHKDMEEKIRKKLQEMIADTDHRLDMLDRQTDRKIRIGRKNAGLPKSGVIADWLVRDMMR
FQPVAKDTSGKPLNNSKANSTEYRMLQRALALFGGEKKRLIPYFRQMNIGGNNPHPFLHETRWESHINI
LSFYRSYLRARKAFLERIGRSDRMENRPFLLLKEPKTDRQTLVAGWKSEFHLPRGIFTEAVRDCLIEMGY
DEVGSYREVGFMAKAVPLYFERACEDRVQPFYDSPFNVGNSLKPKKGRFLSKEERAEEWERGKERFRDLE
AWSHSAARRIEDAFAGIEYASPGNKKKIEQLLRDLSLWEAFESKLKVRADKINLAKLKKEILEAQEHPYH
DFKSWQKFERELRLVKNQDIITWMMCRDLMEENKVEGLDIGTLYLKDIRPNVQEQGSLNVLNRVKPMRLP
VVVYRADSRGHVHKEEAPLATVYIEERDTKLLKQGNFKSFVKDRRLNGLFSFVDTGGLAMEQYPISKLRV
EYELAKYQTARVCVFELTLRLEESLLTRYPHLPDESFRKMLESWSDPLLAKWPELHGKVRLLIAVRNAFS
HNQYPMYDEAVFSSIRKYDPSSPDAIEERMGLNIAHRLSEEVKQAKETVERIIQV >gi|835310921|ref|WP 047447901.1| hypothetical protein [*Alistipes* sp.
ZOR0009] (SEQ ID NO: 133)
MSNEIGAFREHQFAYAPGNEKQEEATFATYFNLALSNVEGMMFGEVESNPDKIEKSLDTLPPAILRQIAS
FIWLSKEDHPDKAYSTEEVKVIVIDLVRRLCFYRNYFSHCFYLDTQYFSDELVDTTAIGEKLPYNFHHF
ITNRLFRYSLPEITLFRWNEGERKYEILRDGLIFFCCLFLKRGQAERFLNELRFFKRIDEEGRIKRTIFT
KYCTRESHKHIGIEEQDFLIFQDIIGDLNRVPKVCDGVVDLSKENERYIKNRETSNESDENKARYRLLIR
EKDKFPYYLMRYIVDFGVLPCITFKQNDYSTKEGRGQFHYQDAAVAQEERCYNFVVRNGNVYYSYMPQAQ
NVVRISELQGTISVEELRNMVYASINGKDVNKSVEQYLYHLHLLYEKILTISGQIIKEGRVDVEDYRPLL
DKLLLRPASNGEELRRELRKLLPKRVCDLLSNRFDCSEGVSAVEKRLKAILLRHEQLLLSQNPALHIDKI
KSVIDYLYLFFSDDEKFRQQPIEKAHRGLKDEEFQMYHYLVGDYDSHPLALWKELEASGRLKPEMRKLTS
ATSLHGLYMLCLKGIVEWCRKQLMSIGKGTAKVEAIADRVGLKLYDKLKEYTPEQLEREVKLVVMHGYAA
AATPKPKAQAAIPSKLTELRFYSFLGKREMSPAAFIRQDKKAQKLWLRNFYIVENIKTLQKRQAAADAAC
KKLYNLVGEVERVHINDKVLVLVAQRYRERLLNVGSKCAVILDNPERQQKLADVYEQNAWLSIRFDDLD
FILTHVNLSNLRKAYNLIPRKHILAFKEYLDNRVKQLCEECRNVRRKEDLCICCSPRYSNLTSWLKENH
SESSIEREAATMMLLDVERKLLSFLLDERRKAIIEYGKFIPFSALVKECRLADAGLCGIRNDVLHDNVIS
YADAIGKLSAYFPKEASEAVEYIRRTKEVREQRREELMANSSQ -continued \>gi|874269987|gb|AKP69887.1| hypothetical protein CG08_1741
[*Riemerella anatipestifer*] (SEQ ID NO: 134)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFKHLYKAFDASLRMVKEDYKAHFIVNLIRDFAHLNRKGKNKQDNPDFNRYR
FEKDGFFTESGLLFFINLFLDKRDAYWMLKKVSGFKASHKQREKMITEVFCRSRILLPKLRLESRYDHNQ
MLLDMLSELSRCPKLLYEKLSEENKKHFQVEADGFLDEIEEEQNPFKDTLIRHQDRFPYFALRYLDLNES
FKSIRFQVDLGTYHYCIYDKKIGDEQEKRHLTRILLSFGRLQDFTEINRPQEWKALTKDLDYKETSNQPF
ISKTIPHYHITDNKIGFRLGTSKELYPSLEIKDGANRIAKYPYNSGFVAHAFISVHELLPLMFYQHLIGK
SEDLLKETVRHIQRIYKDFEEERINTIEDLEKANQGRLPLGAFPKQMLGLLQNKQPDLSEKAKIKIEKLI
AETKLLSHRLNIKLKSSPKLGKRREKLIKTGVLADWLVKDFMRFQPVAYDAQNQPIKSSKANSTEFWFIR
RALALYGGEKNRLEGYFKQINLIGNINPHPFLNKFNWKACRNLVDFYQQYLEQREKFLEAIKNQPWEPYQ
YCLLLKIPKENRKNLVKGWEQGGISLPRGLFTEAIRETLSEDLMLSKPIRKEIKKHGRVGFISRAITLYF
KEKYQDKHQSFYNLSYKLEAKAPLLKREEHYEYWQQNKPQSPTESQRLELHTSDRWKDYLLYKRWQHLEK
KLRLYRNQDVMLWLMTLELTKNHFKELNLNYHQLKLENLAVNVQEADAKLNPLNQTLPMVLPVKVYPATA
FGEVQYHKTPIRTVYIREEHTKALKMGNFKALVKDRRLNGLFSFIKEENDTQKHPISQLRLRRELEIYQS
LRVDAFKETLSLEEKLLNKHISLSSLENEFRALLEEWKKEYAASSMVIDEHIAFIASVRNAFCHNQYPFY
KEALHAPIPLFTVAQPITEEKDGLGIAEALLKVLREYCEIVKSQI \>gi|874285978|gb|AKP71851.1| hypothetical protein CG09_1718
[*Riemerella anatipestifer*] (SEQ ID NO: 135)
MFFSFHNAQRVIFKHLYKAFDASLRMVKEDYKAHFIVNLIRDFAHLNRKGKNKQDNPDFNRYRFEKDGFF
TESGLLFFINLFLDKRDAYWMLKKVSGFKASHKQREKMITEVFCRSRILLPKLRLESRYDHNQMLLDMLS
ELSRCPKLLYEKLSEENKKHFQVEADGFLDEIEEEQNPFKDTLIRHQDRFPYFALRYLDLNESFKSIRFQ
VDLGTYHYCIYDKKIGDEQEKRHLTRILLSFGRLQDFTEINRPQEWKALTKDLDYKETSNQPFISKTIPH
YHITDNKIGFRLGTSKELYPSLEIKDGANRIAKYPYNSGFVAHAFISVHELLPLMFYQHLIGKSEDLLKE
TVRHIQRIYKDFEEERINTIEDLEKANQGRLPLGAFPKQMLGLLQNKQPDLSEKAKIKIEKLIAETKLLS
HRLNIKLKSSPKLGKRREKLIKTGVLADWLVKDFMRFQPVAYDAQNQPIKSSKANSTEFWFIRRALALYG
GEKNRLEGYFKQINLIGNINPHPFLNKFNWKACRNLVDFYQQYLEQREKFLEAIKNQPWEPYQYCLLLKI
PKENRKNLVKGWEQGGISLPRGLFTEAIRETLSEDLMLSKPIRKEIKKHGRVGFISRAITLYFKEKYQDK
HQSFYNLSYKLEAKAPLLKREEHYEYWQQNKPQSPTESQRLELHTSDRWKDYLLYKRWQHLEKKLRLYRN
QDVMLWLMTLELTKNHFKELNLNYHQLKLENLAVNVQEADAKLNPLNQTLPMVLPVKVYPATAFGEVQYH
KTPIRTVYIREEHTKALKMGNFKALVKDRRLNGLFSFIKEENDTQKHPISQLRLRRELEIYQSLRVDAFK
EILSLEEKLLNKHISLSSLENEFRALLEEWKKEYAASSMVIDEHIAFIASVRNAFCHNQYPFYKEALHAP
IPLFTVAQPITEEKDGLGIAEALLKVLREYCEIVKSQI \>gi|874285979|gb|AKP71852.1| hypothetical protein CG09_1721
[*Riemerella anatipestifer*] (SEQ ID NO: 136)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFNSLCILNNTDF \>gi|877802244|dbj|BAR96998.1| hypothetical protein PI17_22270
[*Prevotella intermedia*] (SEQ ID NO: 137)
MEDDKKIKESTNMLDNKHFWAAFLNLARHNVYITVNHINKVLELKNKKDQDIIIDNDQDILAIKTHWEKV
NGDLNKTERLRELMTKHFPFLETAIYIKNKEDKEEVKQEKQAKAQSFDSLKHCLFLFLEKLQEARNYYSH
YKYSESTKEPMLKEKELLKKMYNIFDDNIQLVIKDYQHNKDINPDRTEEEFNYYFTINKKGNIT
ASGLLFFVSLFLEKKDAIWMQQKLRGFKDNRESKKKMTHEVFCRSRMLLPKLRLESTQTQDWILLDMLNE
LIRCPKSLYERLQGEYRKKENVPFDSADEDYDAEQEPFKNILVRHQDRFPYFALRYFDYNEIFTNLRFQI
DLGTYHFSIYKKLIGGQKEDRHLTHKLYGFERIQEFAKQNRIDEWKAIVKDFDIYETSEEPYISETAPHY
HLENQKIGIRFRNDNDEIWPSLKINGENNEKRKYKLDKQYQAEAFLSVHELLPMMFYYLLLKKEEPNNDK
KNASIVEGFIKREIRDIYKLYDAFANGEINNIDDLEKYCEDKGIPKRHLPKQMVAILYDEHKDMAEEEAKR
KQKEMVKDIKKLLATLEKQTQGEIEDGGRNIRLLKSGEIARWLVNDMMRFQPVQKDNEGNPLNNSKANST
EYQMLQRSLALYNKEEKPTRYFRQVNLINSSNPHPFLKWIKWEECNNILSFYRSYLIKKIEFLNKLKPED
WEKNQYFLKLKEPKTNRETLVQGWKNGFNLPRGIFTEPIREWFKRRHLQNDKSEEYEKVETLDRVGLVTKVIP
LFFKKEDSKDKEEYLKKDAQKEINNCVQPFYGFPYNVGNIHKPDEKDFLPSEERKKLWGDKKYKFKGYKA
KVKSKKLIDKEKEEYRSYLEFQSWNKFERELRLVRNQDIVTWLLCTELIDKLKVEGLNVEELKKLRLKDI
DIDTAKQEKNNILNRVMPMQLPVIVYEIDDSHNIVKDRPLHIVYIEETKIKLLKQGNFKALVKDRRLNGL
FSFVDTSSETELKSNPISKSLVEYELGEYQNARIETIKDMLLLEETLIEKYKTLPIDNFSDMLNGWLEGK
DEADKARFQNDVKLLVAVRNAFSHNQYPMRNRIAFANINPFSLSSADTSEEKKLDIANQLKDKIHKIIKR
IIEIEKPIETKE \>gi|885008798|gb|AKQ40303.1| hypothetical protein AS87_08290
[*Riemerella anatipestifer* Yb2] (SEQ ID NO: 138)
MEKPLLPNVYTLKHKFFWGAFLNIARHNAFITICHINEQLGLKTPSNDDKIVDVVCETWNNILNNDHDLL
KKSQLTELILKHFPFLTAMCYHPPKKEGKKKGHQKEQQKEKESEAQSQAEALNPSKLIEALEILVNQLHS
LRNYYSHYKHKKPDAEKDIFKHLYKAFDASLRMVKEDYKAHFIVNLIRDFAHLNRKGKNKQDNPDFNRYR
FEKDGFFTESGLLFFINLFLDKRDAYWMLKKVSGFKASHKQREKMITEVFCRSRILLPKLRLESRYDHNQ
MLLDMLSELSRCPKLLYEKLSEENKKHFQVEADGFLDEIEEEQNPFKDTLIRHQDRFPYFALRYLDLNES
FKSIRFQVDLGTYHYCIYDKKIGDEQEKRHLTRILLSFGRLQDFTEINRPQEWKALTKDLDYKETSNQPF
ISKTIPHYHITDNKIGFRLGTSKELYPSLEIKDGANRIAKYPYNSGFVAHAFISVHELLPLMFYQHLIGK
SEDLLKETVRHIQRIYKDFEEERINTIEDLEKANQGRLPLGAFPKQMLGLLQNKQPDLSEKAKIKIEKLI
AETKLLSHRLNIKLKSSPKLGKRREKLIKTGVLADWLVKDFMRFQPVAYDAQNQPIKSSKANSTEFWFIR
RALALYGGEKNRLEGYFKQINLIGNINPHPFLNKFNWKACRNLVDFYQQYLEQREKFLEAIKNQPWEPYQ
YCLLLKIPKENRKNLVKGWEQGGISLPRGLFTEAIRETLSEDLMLSKPIRKEIKKHGRVGFISRAITLYF
KEKYQDKHQSFYNLSYKLEAKAPLLKREEHYEYWQQNKPQSPTESQRLELHTSDRWKDYLLYKRWQHLEK
KLRLYRNQDVMLWLMTLELTKNHFKELNLNYHQLKLENLAVNVQEADAKLNPLNQTLPMVLPVKVYPATA
FGEVQYHKTPIRTVYIREEHTKALKMGNFKALVKDRRLNGLFSFIKEENDTQKHPISQLRLRRELEIYQS
LRVDAFKETLSLEEKLLNKHISLSSLENEFRALLEEWKKEYAASSMVIDEHIAFIASVRNAFCHNQYPFY
KEALHAPIPLFTVAQPITEEKDGLGIAEALLKVLREYCEIVKSQI \>gi|896419352|ref|WP_049354263.1| hypothetical protein [*Riemerella anatipestifer*] (SEQ ID NO: 139)
MFFSFHNAQRVIFKHLYKAFDASLRMVKEDYKAHFIVNLIRDFAHLNRKGKNKQDNPDFNRYRFEKDGFF
TESGLLFFINLFLDKRDAYWMLKKVSGFKASHKQREKMITEVFCRSRILLPKLRLESRYDHNQMLLDMLS
ELSRCPKLLYEKLSEENKKHFQVEADGFLDEIEEEQNPFKDTLIPLQRDRFPYFALRYLDLNESFKSIRFQ
VDLGTYHYCIYDKKIGDEQEKRHLTRILLSFGRLQDFTEINRPQEWKALTKDLDYKETSNQPFISKTIPH
YHITDNKIGFRLGTSKELYPSLEIKDGANRIAKYPYNSGFVAHAFISVHELLPLMFYQHLIGKSEDLLKE
TVRHIQRIYKDFEEERINTIEDLEKANQGRLPLGAFPKQMLGLLQNKQPDLSEKAKIKIEKLIAETKLLS
HRLNIKLKSSPKLGKRREKLIKTGVLADWLVKDFMRFQPVAYDAQNQPIKSSKANSTEFWFIRRALALYG
GEKNRLEGYFKQINLIGNINPHPFLNKFNWKACRNLVDFYQQYLEQREKFLEAIKNQPWEPYQYCLLLKI
PKENRKNLVKGWEQGGISLPRGLFTEAIRETLSEDLMLSKPIRKEIKKHGRVGFISRAITLYFKEKYQDK
HQSFYNLSYKLEAKAPLLKREEHYEYWQQNKPQSPTESQRLELHTSDRWKDYLLYKRWQHLEKKLRLYRN
QDVMLWLMTLELTKNHFKELNLNYHQLKLENLAVNVQEADAKLNPLNQTLPMVLPVKVYPATAFGEVQYH
KTPIRTVYIREEHTKALKMGNFKALVKDRRLNGLFSFIKEENDTQKHPISQLRLRRELEIYQSLRVDAFK
EILSLEEKLLNKHISLSSLENEFRALLEEWKKEYAASSMVIDEHIAFIASVRNAFCHNQYPFYKEALHAP
IPLFTVAQPITEEKDGLGIAEALLKVLREYCEIVKSQI \>gi|914347928|gb|AKV64040.1| hypothetical protein PGA7_00008170 [*Porphyromonas gingivalis*] (SEQ ID NO: 140)
MNIVPASENKGQSRIVEDDPQYFGLYLNLARENLIEVESHVRIKFGKKKLNEESLKQSLLCDHLLSVDRW
TKVYGHSRRYLPFLHYFDPDSQIEKDHDSKTGVDPDSAQRLIRELYSLLDFLRNDFSHNRLDGITFEHLE
VSPDISSFITGTYSLACGRAQSRFADFFKPDDFVLAKNRKEQLISVADGKECLIVSGLAFFICLFLDREQ
ASGMLSRIRGFKRIDENWARAVHETFCDLCIRHPHDRLESSNIKEALLLDMLNELNRCPRILYDMLPEEE
RAQFLPALDENSMNNLSENSLNEESRLLWDGSSDWAEALTKRIRHQDRFPYLMLRFIEEMDLLKGIRFRV
DLGEIELDSYSKKVGRNGEYDRTITDHALAFGKLSDFQNEEEVSRMISGEASYPVRFSLFAPRYAIYDNK
IGYCHTSDPVYPKSKTGEKRALSNPQSMGFISVHNLRKLLLMELLCEGSFSRMQSDPLRKANRILDETAE
GKLQFSALFPEMRHRFIPPQNPKSKDRREKAETTLEKYKQEIKGRKDKLNSQLLSAFDMNQRQLPSRLLD
EWMNIRPASHSVKLRTYVKQLNEDCRLRLRKPRKDGDGKARAIPLVGEMATFLSQDIVRMIISEETKKLI
TSAYYNEMQRSLAQYAGEENRRQFRAIVAELHLLDPSSGHPFLSATMETAHRYTEDFYKCYLEKKREWLA
KTFYRPEQDENTKRRISVFFVPDGEARKLLPLLIRRRMKEQNDLQDWIRNKQAHPIDLPSHLFDSKIMEL
LKVKDGKKKWNEAFKDWWSTKYPDGMQPFYGLRRELNIHGKSVSYIPSDGKKFADCYTHLMEKTVQDKKR
ELRTAGKPVPPDLAADIKRSFHRAVNEREFMLRLVQEDDRLMLMAINKMMTDREEDILPGLKNIDSILDE
ENQFSLAVHAKVLEKEGEGGDNSLSLVPATIEIKSKRKDWSKYIRYRYDRRVPGLMSHFPEHKAILDEVK
ILLGEYDRCRIKIFDWAFALEGAIMSDRDLKPYLHESSSREGKSGEHSTLVKMLVEKKGCLTPDESQYLI
LIRNKAAHNQFPCAAEMPLIYRDVSAKVGSIEGSSAKDLPEGSSLVDSLWKKYEMIIRKILPILDPENRF
FGKLLNNMSQPINDL \>gi|914348650|gb|AKV64762.1| hypothetical protein PGA7_00015700 [*Porphyromonas gingivalis*] (SEQ ID NO: 141)
MTEQNEKPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPLFDGNMLQRLYNVFDVSVQRVKRDHEHNDKVDPHRHFNHLVRKGKKKDY
GNNDNPFFKHHFVDREEKVTEAGLLFFVSLFLEKRDAIWMQKKIRGFKGPTEAYQQMTNEVFCRSRISLP
KLKLESLRIDDWMLLDMLNELVRCPKLLYDRLREEDRARFRVPVDILSDEDDIDGTEEDPFKNILVRHQD
RPFPYFALRYFDLKKVFTSLRFHIDLGTYHFAIYKKNIGEQPEDRHLTRNLYGFGRIQDFAEEHRPEEWKR
LVRDLDYFETGDKPYITQTTPHYHIEKGKIGLRFVPEGQLLWPSPEVGATRTGRSKYAQDKRFTAEAFLS
VHELMPMMFYYFLLREKYSEEASAEKVQGRIKRVIEDVYAVYDAFARDEINTRDELDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDREENHRFLLLKEPKTDRQTLVAGWKSEFHLPRGIFTEAVRDCLIEMGY
DEVGSYKEVGFMAKAVPLYFERACKDRVQPFYDYPFNVGNSLKPKKGRFLSKEKRAEEWESGKERFRDLE
AWSHSAARRIEDAFVGIEYASWENKKKIEQLLQDLSLWETFESKLKVKADKINIAKLKKEILEAKEHPYH
DPFKSWQFKFERELRLVKNQDIITWMMCRDLMEENKVEGLDIGTLYLKDIRTDVQEQGSLNVLNHVKPMRLP
VVVYRADSRGHVHKEEAPLATVYIEERDTKLLKQGNFKSFVKDRRLNGLFSFVDTGALAMEQYPISKLRV
EYELAKYQTARVCAFEQTLELEESLLTRYPHLPDESFREMLESWSDPLLDKWPDLQREVRLLIAVRNAFS
HNQYPMYDETIFSSIRKYDPSSLDAIEERMGLNIAHRLSEEVKLAKEMVERIIQA \>gi|916087402|ref|WP_050955369.1| hypothetical protein [*Prevotella intermedia*] (SEQ ID NO: 142)
MEDDKKIKESTNMLDNKHFWAAFLNLARHNVYITVNHINKVLELKNKKDQDIIIDNDQDILAIKTHWEKV
NGDLNKTERLRELMTKHFPFLETAIYIKNKEDKEEVQEKQAKAQSFDSLKHCLFLFLEKLQEARNYYSH
YKYSESTKEPMLEKELLKKMYNIFDDNIQLVIKDYQHNKDINPDEDFKHLDRTEEEFNYYFTINKKGNIT
ASGLLFFVSLFLEKKDAIWMQQKLRGFKDNRESKKKMTHEVFCRSRMLLPKLRLESTQTQDWILLDMLNE
LIRCPKSLYERLQGEYRKKENVPFDSADEDYDAEQEPFKNILVRHQDRFPYFALRYFDYNEIFTNLRFQI
DLGTYHFSIYKKLIGGQKEDRHLTHKLYGFERIQEFAKQNRIDEWKAIVKDFDIYETSEEPYISETAPHY
HLENQKIGIRFRNDNDEIWPSLKINGENNEKRKYKLDKQYQAEAFLSVHELLPMMFYYLLLKKEEPNNDK
KNASIVEGFIKREIRDIYKLYDAFANGEINNIDDLEKYCEDKGIPKRHLPKQMVAILYDEHKDMAEEAKR
KQKEMVKDIKKLLATLEKQTQGEIEDGGRNIRLLKSGEIARWLVNDMMRFQPVQKDNEGNPLNNSKANST
EYQMLQRSLALYNKEEKPTRYFRQVNLINSSNPHPFLKWIKWEECNNILSFYRSYLIKKIEFLNKLKPED
WEKNQYFLKLKEPKTNRETLVQGWKNGFNLPRGIFTEPIREWFKRHQNDSEEYEKVETLDRVGLVTKVIP
LFFKKEDSKDKEEYLKKDAQKEINNCVQPFYGFPYNVGNIHKPDEKDFLPSEERKKLWGDKKYKFKGYKA
KVKSKKLIDKEKEEYRSYLEFQSWNKFERELRLVRNQDIVTWLLCTELIDKLKVEGLNVEELKKLRLKDI
DIDTAKQEKNNILRVMPMQLPVIVYEIDDSHNIVKDRPLHIVYIEETKIKLLKQGNFKALVKDRRLNGL
FSFVDTSSETELKSNPISKSLVEYELGEYQNARIETIKDMLLLEETLIEKYKTLPIDNFSDMLNGWLEGK
DEADKARFQNDVKLLVAVRNAFSHNQYPMRNRIAFANINPFSLSSADTSEEKKLDIANQLKDKIHKIIKR
IIEIEKPIETKE \>gi|916715432|ref|WP_051322523.1| hypothetical protein [*Bacteroides pyogenes*] (SEQ ID NO: 143)
MALLNVRKVENHIRKWLGDVALLPEKSGFHSLLTIDNLSSAKWIRFYYKSRKFLPFLEMFDSDKKSYENR
RETTECLDTIDRQKISSLLKEVYGKLQDIRNAFSHYHIDDQSVKHTALIISSEMHRFIENAYSFALQKTR

```
ARFTGVFVETDFLQAEEKGDNKKFFAIGGNEGIKLKDNALIFLICLFLDREEAFKFLSRATGFKSTKEKG
FLAVRETFCALCCRQPHERLLSVNPREALLMDMLNELNRCPDILFEMLDEKDQKSFLPLLGEEEQAHILE
NSLNDELCEAIDDPFEMIASLSKRVRYKNRFPYLMLRYIEEKNLLPFIRFRIDLGCLELASYPKKMGEEN
NYERSVIDHAMAFGRLTDFHNEDAVLQQIIKGITDEVRFSLYAPRYAIYNNKIGFVRIGGSDKISFPILK
KKGGEGHCVAYTLQNIKSFGFISIYDLRKILLLSFLDKDKAKNIVSGLLEQCEKHWKDLSENLFDAIRTE
LQKEFPVPLIRYTLPRSKGGKLVSSKLADKQEKYESEFERRKEKLTEILSEKDFDLSQIPRRMIDEWLNV
LPTSREKKLKGYVETLKLDCRERLRVFEKREKGEHPVPPRIGEMAIDLAKDIIRMVIDQGVKQRITSAYY
SEIQRCLAQYAGDDNRRHLDSIIRELRLKDTKNGHPFLGKVLRPGLGHTEKLYQRYFEEKKEWLEATFYP
AASPKRVPRFVNPPIGKQKELPLIIRNLMKERPEWRDWKQRKNSHPIDLPSQLFENEICRLLKDKIGKEP
SGKLKWNEMFKLYWDKEFPNGMQRFYRCKRRVEVFDKVVEYEYSEEGGNYKKYYEALIDEVVRQKISSSK
EKSKLQVEDLILSVRRVFKRAINEKEYQLRLLCEDDRLLFMAVRDLYDWKEAQLDLDKIDNMLGEPVSVS
QVIQLEGGQPDAVIKAECKLKDVSKLMRYCYDGRVKGLMPYFANHEATQEQVEMELRHYEDHRRRVFNWV
FALEKSVLKNEKLRRFYEESQGGCEHRRCIDALRKASLVSEEEYEFLVHIRNKSAHNQFPDLEIGKLPPN
VTSGFCECIWSKYKAIICRIIPFIDPERRFFGKLLEQK

>gi|916915772|ref|WP_051522484.1| hypothetical protein [Prevotella
saccharolytica] (SEQ ID NO: 144)
MEDKPFWAAFFNLARHNVYLIVNHINKLLDLEKLYDEGKHKEIFEREDIFNISDDVMNDANSNGKKRKLD
IKKIWDDLDIDLTRKYQLRELILKHFPFIQPAIIGAQTKERTTIDKDKRSTSTSNDSLKQTGEGDINDLL
SLSNVKSMFFRLLQILEQLRNYYSHVKHSKSAIMPNFDEDLLNWMRYIFIDSVNKVKEDYSSNSVIDPNT
SFSHLIYKDEQGKIKPCRYPFTSKDGSINAFGLLFFVSLFLEKQDSIWMQKKIPGFKKASENYMKMTNEV
FCRNHILLPKIRLETVYDKDWMLLDMLNEVVRCPLSLYKRLIPAAQNKFKVPEKSSDNANRQEDDNPFSR
ILVRHQNRFPYFVLRFFDLNEVFTTLRFQINLGCYHFAICKKQIGDKKEVHHLIRTLYGFSRLQNFTQNT
RPEEWNTLVKITEPSSGNDGKIVQGVPLPYISYTIPHYQIENEKIGIKIFDGDTAVDTDIWPSVSTEKQL
NKPDKYTLIPGFKADVFLSVHELLPMMFYYQLLLCEGMLKIDAGNAVEKVLIDTRNAIFNLYDAFVQEKI
NTITDLENYLQDKPILIGHLPKQMIDLLKGHQRDMLKAVEQKKAMLIKDTERRLKLLDKQLKQETDVAAK
NIGILLKNGQIADWLVNDMMRFQPVKRDKEGNPINCSKANSTEYQMLQRAFAFYAIDSCRLSRYFTQLHL
IHSDNSHLFLSRFEYDKQPNLIAFYAAYLKAKLEFLNELQPQNWASDNYFLLLRAPKNDRQKLAEGWKNG
FNLPRGLFTEKIKTWFNEHKTIVDISDCDIFKNRVGQVARLIPVFFDKKFKDHSQPFYRYDFNVGNVSKP
TEANYLSKGREELFKSYQNKFKNNIPAEKTKEYREYKNFSLWKKFERELRLIKNQDILIWLMCKNLFDE
KIKPKKDILEPRIAVSYIKLDSLQINTSTAGSLNALAKVVPMTLAIHIDSPKPKGKAGNNEKENKEFTVY
IKEEGTKLLKWGNFKILLADRRIKGLFSYIEHDDIDLKQHPLIKRRVDLELDLYQTCRIDIFQQTLGLEA
QLLDKYSDLNIDNFYQMLIGWRKKEGIPRNIKEDIDFLKDVRNAFSHNQYPDSKKIAFRRIRKFNPKELI
LEEEEGLGIATQMYKEVEKVVNRIKRIELFD >gi|918017236|ref|WP_052309609.1| hypothetical protein [Prevotella
saccharolytica] (SEQ ID NO: 145)
MEKENVQGSHIYYEPTDKCFWAAFYNLARHNAYLTIAHINSFVNSKKGINNDDKVLDIIDDWSKFDNDLL
MGARLNKLILKHFPFLKAPLYQLAKRKTRKQQGKEQQDYEKKGDEDPEVIQEAIANAFKMANVRKILHAF
LKQLEDLRNHFSHYNYNSPAKKMEVKFDDGFCNKLYYVFDAALQMVKDDNRMNPEINMQTDFEHLVRLGR
NRKIPNIFKYNFINSDGTINNNGLLFFVSLFLEKRDAIWMQKKIKGFKGGTENYMRMTNEVFCRNRMVIP
KLRLETDYDNHQLMFDMLNELVRCPLSLYKRLKQEDQDKFRVPIEFLDEDNEADNPYQENANSDENPTEE
TDPLKNILVRHQHRFPYFVLRYFDLNEVFKQLRFQINLGCYHFSIYDKTIGERTEKRHLTRILFGFDRLQ
NFSVKLQPEHWKNMVKHLDTEESSDKPYLSDAMPHYQIENEKIGIHFLKIDTEKKETVWPSLEVEEVSSN
RNKYKSEKNLTADAFLSTHELLPMMFYYQLLSSEEKTRAAAGDKVQGVLQSYRKKIFDIYDDFANGTINS
MQKLDERLAKDNLLRGNMPQQMLAILEHQEPDMEQKAKEKLDRLITETKKRIGKLEDQFKQKVRIGKRRA
DLPKVGSIADWLVNDMMRFQPAKRNADNIGVPDSKANSTEYRLLQEALAFYSAYKDRLEPYFRQVNLIGG
INPHPFLHRVDWKKCNHLLSFYHDYLEAKEQYLSHLSPADWQKHQHFLLLKVRKDIQNEKKDWKKSLVAG
WKNGFNLPRGLFTESIKTWFSTDADKVQIIDTKLFENRVGLIAKLIPLYYDKVYNDKPQPFYQYPFNIND
RYKPEDIRKRFTAASSKLWNEKKMLYKNAQPDSSDKIEYPQYLDFLSWKKLERELRMLRNQDMMVWLMCK
DLFAQCTVEGVEFADLKLSQLEVDVNVQDNLNVLNNVSSMILPLSVYPSDAQGNVLRNSKPLHIVYVQEN
NTKLLKQGNFKSLLKDRRLNGLFSFIAAEGEDLQQHPLIKNRLEYELSIYQTMRISVFEQTLQLEKAILT
RNKTLCGNNFNNLLNSWSEHRTDKKILQPDIDFLIAVRNAFSHNQYPMSTNIVMQGIEKFNIQTPKLEEK
DGLGIASQLAKKIKDAASRLQNIINGGIN >gi|919116504|ref|WP_052672145.1| hypothetical protein [Prevotella
intermedia] (SEQ ID NO: 146)
MEDDKKITESTNMLDKNHFWAAFLNLARHNVYITVNHINKVLELKNKKDQDIIIDNDQDILAIKTHWEKV
NGDLNKTERLRELMTKHFPFLETAIYIKNKEDKEEVKQEKQAEAQSLESLKDCLFLFLEKLQEARNYYSH
YKYSESTKEPMLEEGLLEKMYNIFDDNIQLVIKDYQHNKDINPDEDFKHLDRKGQFKYSFADNEGNITES
GLLFFVSLFLEKKDAIWMQQKLIGFKDNRESKKKMTHEVFCRRRMLLPKLRLESTQTQDWILLDMLNELI
RCPKSLYERLQGEYRKKENVPFDSADEDYDAEQEPFKNILVRHQDRFPYFALRYFDYNEIFTNLRFQIDL
GIYHFSIYKKLIGGQKEDRHLTHKLYGFERIQEFAKQNRPDEWKALVKDLDIYETSNERYISETTPHYHL
ENQKIGIRFRNGNKEIWPSLKINGENNEKSKYKLDKPYQAEAFLSVHELLPMMFYYLLLKKEEPNNDKKN
ASIVEGFIKREIRDMYKLYDAFANGEINNIGDLEKYCEDKGIPKRHLPKQMVAILYDEPKDMVKEAKRKQ
KEMVKDIKKLLATLEKQTQEEIEDGGRNIRLLKSGEIARWLVNDMMRFQPVQKDNEGNPLNNSKANSTEY
QMLQRSLALYNKEEKPTRYFRQVNLINSSNPHPFLKWIKWEECNNILSFYRNYLIKKIEFLNKLKPEDWE
KNQYFLKLKEPKTNRETLVQGWKNGFNLPRGIFTEPIREWFKRHQNDSKEYEKVEALKRVGLVTKVIPLF
FKEEYFKEDAQKEINNCVQPFYSFPYNVGNIHKPDEKDFLPSEERKKLWGDKKDKFKGYKAKVKSKKLID
KEKEEYRSYLEFQSWNKFERELRLVRNQDIVTWLLCTELIDKMKVEGLNVEELQKLRLKDIDTDTAKQEK
NNILNRIMPMQLPVIVYEIDDSHNIVKDRPLHIVYIEETKIKLLKQGNFKALVKDRRLNGLFSFVDTSSK
AELKDKPISKSVVEYELGEYQNARIETIKDMLLLEKTLIKKYEKLPIDNFSDMLNGWLEGKDESDKARFQ
NDVKLLVAVRNAFSHNQYPMRNRIAFANINPFSLSSADISEEKKLDIANQLKDKIHKIIKKIIEIEKPIE
TKE >gi|919932447|ref|WP_052912312.1| hypothetical protein [Porphyromonas
gingivalis] (SEQ ID NO: 147)
MTEQNEKPYNGTYYTLEDKHFWAAFFNLARHNAYITLAHIDRQLAYSKADITNDEDILFFKGQWKNLDND
LERKARLRSLILKHFSFLEGAAYGKKLFESQSSGNKSSKKKELIKKEKEELQANALSLDNLKSILFDFLQ
KLKDFRNYYSHYRHPESSELPFDGNMLQRLYNVFDVSVQRVKRDHEHNDKVDPHRHFNHLVRKGKKDKY
GNNDNPFFKHHFVDREEKVTEAGLLFFVSLFLEKRDAIWMQKKIRGFKGGTEAYQQMTNEVFCRSRISLP
```

-continued
```
KLKLESLRIDDWMLLDMLNELVRCPKLLYDRLREEDRARFRVPVDILSDEDDIDGTEEDPFKNILVRHQD
RFPYFALRYFDLKKVFTSLRFHIDLGTYHFAIYKKNIGEQPEDRHLTRNLYGFRIQDFAEEHRPEEWKR
LVRDLDYFETGDKPYITQTTPHYHIEKGKIGLRFVPEGQLLWPSPEVGATRTGRSKYAQDKRFTAEAFLS
VHELMPMMFYYFLLREKYSEEASAEKVQGRIKRVIEDVYAVYDAFARDEINTRDELDACLADKGIRRGHL
PRQMIAILSQEHKDMEEKVRKKLQEMIADTDHRLDMLDRQTDRKIRIGRKNAGLPKSGVIADWLVRDMMR
FQPVAKDTSGKPLNNSKANSTEYRMLQRALALFGGEKERLIPYFRQMNLIGGNNPHPFLHETRWESHINI
LSFYRSYLKARKAFLQSIGRSDREENHRFLLLKEPKTDRQTLVAGWKSEFHLPRGIFTEAVRDCLIEMGY
DEVGSYKEVGFMAKAVPLYFERACKDRVQPFYDYPFNVGNSLKPKKGRFLSKEKRAEEWESGKERFRDLE
AWSHSAARRIEDAFVGIEYASWENKKKIEQLLQDLSLWETFESKLKVKADKINIAKLKKEILEAKEHPYH
DFKSWQKFERELRLVKNQDIITWMMCRDLMEENKVEGLDIGTLYLKDIRTDVQEQGSLNVLNHVKPMRLP
VVVYRADSRGHVHKEEAPLATVYIEERDTKLLKQGNFKSFVKDRRLNGLFSFVDTGALAMEQYPISKLRV
EYELAKYQTARVCAFEQTLELEESLLTRYPHLPDESFREMLESWSDPLLDKWPDLQREVRLLIAVRNAFS
HNQYPMYDETIFSSIRKYDPSSLDAIEERMGLNIAHRLSEEVKLAKEMVERIIQA
```

Large protein sequences:

```
>1 hypothetical protein [Bergeyella zoohelcum] (SEQ ID NO: 148)
MENKTSLGNNIYYNPFKPQDKSYFAGYFNAAMENTDSVFRELGKRLKGKEYTSENFFDAIFKEN
ISLVEYERYVKLLSDYFFMARLLDKKEVPIKERKENFKKNFKGIIKAVRDLRNFYTHKEHGEVE
ITDEIFGVLDEMLKSTVLTVKKKKVKTDKTKEILKKSIEKQLDILCQKKLEYLRDTARKIEEKR
RNQRERGEKELVAPFKYSDKRDDLIAAIYNDAFDVYIDKKKDSLKESSKAKYNTKSDPQQEEGD
LKIPISKNGVVFLLSLFLTKQEIHAFKSKIAGFKATVIDEATVSEATVSHGKNSICFMATHEIF
SHLAYKKLKRKVRTAEINYGEAENAEQLSVYAKETLMMQMLDELSKVPDVVYQNLSEDVQKTFI
EDWNEYLKENNGDVGTMEEEQVIHPVIRKRYEDKFNYFAIRFLDEFAQFPTLRFQVHLGNYLHD
SRPKENLISDRRIKEKITVFGRLSELEHKKALFIKNTETNEDREHYWEIFPNPNYDFPKENISV
NDKDFPIAGSILDREKQPVAGKIGIKVKLLNQQYVSEVDKAVKAHQLKQRKASKPSIQNIIEEI
VPINESNPKEAIVFGGQPTAYLSMNDIHSILYEFFDKWEKKKEKLEKKGEKELRKEIGKELEKK
IVGKIQAQIQQIIDKDTNAKILKPYQDGNSTAIDKEKLIKDLKQEQNILQKLKDEQTVREKEYN
DFIAYQDKNREINKVRDRNHKQYLKDNLKRKYPEAPARKEVLYYREKGKVAVWLANDIKRFMPT
DFKNEWKGEQHSLLQKSLAYYEQCKEELKNLLPEKVFQHLPFKLGGYFQQKYLYQFYTCYLDKR
LEYISGLVQQAENFKSENKVFKKVENECFKFLKKQNYTHKELDARVQSILGYPIFLERGFMDEK
PTIIKGKTFKGNEALFADWFRYYKEYQNFQTFYDTENYPLVELEKKQADRKRKTKIYQQKKNDV
FTLLMAKHIFKSVFKQDSIDQFSLEDLYQSREERLGNQERARQTGERNTNYIWNKTVDLKLCDG
KITVENVKLKNVGDFIKYEYDQRVQAFLKYEENIEWQAFLIKESKEEENYPYVVEREIEQYEKV
RREELLKEVHLIEEYILEKVKDKEILKKGDNQNFKYYILNGLLKQLKNEDVESYKVFNLNTEPE
DVNINQLKQEATDLEQKAFVLTYIRNKFAHNQLPKKEFWDYCQEKYGKIEKEKTYAEYFAEVFK
KEKEALIK >2 hypothetical protein [Prevotella intermedia] (SEQ ID NO: 149)
MEDDKKTTDSIRYELKDKHFWAAFLNLARHNVYITVNHINKILEEGEINRDGYETTLKNTWNEI
KDINKKDRLSKLIIKHFPFLEAATYRLNPTDTTKQKEEKQAEAQSLESLRKSFFVFIYKLRDLR
NHYSHYKHSKSLERPKFEEGLLEKMYNIFNASIRLVKEDYQNKDINPDEDFKHLDRTEEEFNY
YFTKDNEGNITESGLLFFVSLFLEKKDAIWMQQKLRGFKDNRENKKKMTNEVFCRSRMLLPKLR
LQSTQTQDWILLDMLNELIRCPKSLYERLREEDREKFRVPIEIADEDYDAEQEPFKNTLVRHQD
RFPYFALRYFDYNEIFTNLRFQIDLGTYHFSIYKKQIGDYKESHHLTHKLYGFERIQEFTKQNR
PDEWRKFVKTFNSFETSKEPYIPETTPHYHLENQKIGIRFRNDNDKIWPSLKTNSEKNEKSKYK
LDKSFQAEAFLSVHELLPMMFYYLLLKTENTDNDNEIETKKKENKNDKQEKHKIEEIIENKITE
IYALYDTFANGEIKSIDELEEYCKGKDIEIGHLPKQMIAILKDEHKVMATEAERKQEEMLVDVQ
KSLESLDNQINEEIENVERKNSSLKSGKIASWLVNDMMRFQPVQKDNEGKPLNNSKANSTEYQL
LQRTLAFFGSEHERLAPYFKQTKLIESSNPHPFLKDTEWEKCNNILSFYRSYLEAKKNFLESLK
PEDWEKNQYFLKLKEPKTKPKTLVQGWKNGFNLPRGIFTEPIRKWFMKHRENITVAELKRVGLV
AKVIPLFFSEEYKDSVQPFYNYHFNVGNINKPDEKNFLNCEERRELLRKKKDEFKKMTDKEKEE
NPSYLEFKSWNKFERELRLVRNQDIVTWLLCMELFNKKKIKELNVEKIYLKNINTNTTKKEKNT
EEKNGEEKNIKEKNNILNRIMPMRLPIKVYGRENFSKNKKKKIRRNTFFTVYIEEKGTKLLKQG
NFKALERDRRLGGLFSFVKTPSKAESKSNTISKLRVEYELGEYQKARIEIIKDMLALEKTLIDK
YNSLDTDNFNKMLTDWLELKGEPDKASFQNDVDLLIAVRNAFSHNQYPMRNRIAFANINPFSLS
SANTSEEKGLGIANQLKDKTHKTIEKIIEIEKPIETKE >3 hypothetical protein [Prevotella buccae] (SEQ ID NO: 150)
MQKQDKLFVDRKKNAIFAFPKYITIMENKEKPEPIYYELTDKHFWAAFLNLARHNVYTTINHIN
RRLEIAELKDDGYMMGIKGSWNEQAKKLDKKVRLRDLIMKHFPFLEAAAYEMTNSKSPNNKEQR
EKEQSEALSLNNLKNVLFIFLEKLQVLRNYYSHYKYSEESPKPIFETSLLKNMYKVFDANVRLV
KRDYMHHENIDMQRDFTHLNRKKQVGRTKNIIDSPNFHYHFADKEGNMTIAGLLFFVSLFLDKK
DAIWMQKKLKGFKDGRNLREQMTNEVFCRSRISLPKLKLENVQTKDWMQLDMLNELVRCPKSLY
ERLREKDRESFKVPFDIFSDDYNAEEEPFKNTLVRHQDRFPYFVLRYFDLNEIFEQLRFQIDLG
TYHFSIYNKRIGDEDEVRHLTHHLYGFARIQDFAPQNQPEEWRKLVKDLDHFETSQEPYISKTA
PHYHLENEKIGIKFCSAHNNLFPSLQTDKTCNGRSKFNLGTQFTAEAFLSVHELLPMMFYYLLL
TKDYSRKESADKVEGIIRKEISNIYAIYDAFANNEINSIADLTRRLQNTNILQGHLPKQMISIL
KGRQKDMGKEAERKIGEMIDDTQRRLDLLCKQTNQKIRIGKRNAGLLKSGKIADWLVNDMMRFQ
PVQKDQNNIPINNSKANSTEYRMLQRALALFGSENFRLKAYFNQMNLVGNDNPHPFLAETQWEH
QTNILSFYRNYLEARKKYLKGLKPQNWKQYQHFLILKVQKTNRNTLVTGWKNSFNLPRGIFTQP
IREWFEKHNNSKRIYDQILSFDRVGFVAKAIPLYFAEEYKDNVQPFYDYPFNIGNRLKPKKRQF
LDKKERVELWQKNKELFKNYPSEKKKTDLAYLDFLSWKKFERELRLIKNQDIVTWLMFKELFNM
ATVEGLKIGEIHLRDIDTNTANEESNNILNRIMPMKLPVKTYETDNKGNILKERPLATFYIEET
ETKVLKQGNFKALVKDRRLNGLFSFAETTDLNLEEHPISKLSVDLELIKYQTTRISIFEMTLGL
EKKLIDKYSTLPTDSFRNMLERWLQCKANRPELKNYVNSLIAVRNAFSHNQYPMYDATLFAEVK
KFTLFPSVDTKKIELNIAPQLLEIVGKAIKEIEKSENKN >4 hypothetical protein [Porphyromonas gingivalis] (SEQ ID NO: 151)
MNTVPASENKGQSRTVEDDPQYFGLYLNLARENLIEVESHVRIKFGKKKLNEESLKQSLLCDHL
LSVDRWTKVYGHSRRYLPFLHYFDPDSQIEKDHDSKTGVDPDSAQRLIRELYSLLDFLRNDFSH
```

-continued

NRLDGTTFEHLEVSPDISSFITGTYSLACGRAQSRFAVFFKPDDFVLAKNRKEQLISVADGKEC
LTVSGFAFFICLFLDREQASGMLSRIRGFKRTDENWARAVHETFCDLCIRHPHDRLESSNTKEA
LLLDMLNELNRCPRILYDMLPEEERAQFLPALDENSMNNLSENSLDEESRLLWDGSSDWAEALT
KRIRHQDRFPYLMLRFIEEMDLLKGIRFRVDLGEIELDSYSKKVGRNGEYDRTITDHALAFGKL
SDFQNEEEVSRMISGEASYPVRFSLFAPRYAIYDNKIGYCHTSDPVYPKSKTGEKRALSNPQSM
GFISVHDLRKLLLMELLCEGSFSRMQSDFLRKANRILDETAEGKLQFSALFPEMRHRFIPPQNP
KSKDRREKAETTLEKYKQEIKGRKDKLNSQLLSAFDMDQRQLPSRLLDEWMNIRPASHSVKLRT
YVKQLNEDCRLRLRKFRKDGDGKARAIPLVGEMATFLSQDIVRMIISEETKKLITSAYYNEMQR
SLAQYAGEENRRQFRAIVAELRLLDPSSGHPFLSATMETAHRYTEGFYKCYLEKKREWLAKIFY
RPEQDENTKRRISVFFVPDGEARKLLPLLIRRRMKEQNDLQDWIRNKQAHPIDLPSHLFDSKVM
ELLKVKDGKKKWNEAFKDWWSTKYPDGMQPFYGLRRELNIHGKSVSYIPSDGKKFADCYTHLME
KTVRDKKRELRTAGKPVPPDLAADIKRSFHRAVNEREFMLRLVQEDDRLMLAINKMMTDREED
ILPGLKNIDSILDEENQFSLAVHAKVLEKEGEGGDNSLSLVPATIEIKSKRKDWSKYIRYRYDR
RVPGLMSHFPEHKATLDEVKTLLGEYDRCRIKIFDWAFALEGAIMSDRDLKPYLHESSSREGKS
GEHSTLVKMLVEKKGCLTPDESQYLILIRNKAAHNQFPCAAEMPLIYRDVSAKVGSIEGSSAKD
LPEGSSLVDSLWKKYEMIIRKILPILDPENRFFGKLLNNMSQPINDL

>5 hypothetical protein [Bacteroides pyogenes] (SEQ ID NO: 152)
MESIKNSQKSTGKTLQKDPPYFGLYLNMALLNVRKVENHIRKWLGDVALLPEKSGFHSLLTTDN
LSSAKWTRFYYKSRKFLPFLEMFDSDKKSYENRRETAECLDTIDRQKISSLLKEVYGKLQDIRN
AFSHYHIDDQSVKHTALIISSEMHRFIENAYSFALQKTRARFTGVFVETDFLQAEEKGDNKKFF
AIGGNEGIKLKDNALIFLICLFLDREEAFKFLSRATGFKSTKEKGFLAVRETFCALCCRQPHER
LLSVNPREALLMDMLNELNRCPDILFEMLDEKDQKSFLPLLGEEEQAHILENSLNDELCEAIDD
PFEMIASLSKRVRYKNRFPYLMLRYIEEKNLLPFIRFRIDLGCLELASYPKKMGEENNYERSVT
DHAMAFGRLTDFHNEDAVLQQITKGITDEVRFSLYAPRYAIYNNKIGFVRTSGSDKISFPTLKK
KGGEGHCVAYTLQNTKSFGFISIYDLRKILLLSFLDKDKAKNIVSGLLEQCEKHWKDLSENLFD
AIRTELQKEFPVPLIRYTLPRSKGGKLVSSKLADKQEKYESEFERRKEKLTEILSEKDFDLSQI
PRRMIDEWLNVLPTSREKKLKGYVETLKLDCRERLRVFEKREKGEHPLPPRIGEMATDLAKDII
RMVIDQGVKQRITSAYYSEIQRCLAQYAGDDNRRHLDSIIRELRLKDTKNGHPFLGKVLRPGLG
HTEKLYQRYFEEKKEWLEATFYPAASPKRVPRFVNPPTGKQKELPLIIRNLMKERPEWRDWKQR
KNSHPIDLPSQLFENEICRLLKDKIGKEPSGKLKWNEMFKLYWDKEFPNGMQRFYRCKRRVEVF
DKVVEYEYSEEGGNYKKYYEALIDEVVRQKISSSKEKSKLQVEDLTLSVRRVFKRAINEKEYQL
RLLCEDDRLLFMAVRDLYDWKEAQLDLDKIDNMLGEPVSVSQVIQLEGGQPDAVIKAECKLKDV
SKLMRYCYDGRVKGLMPYFANHEATQEQVEMELRHYEDHRRRVFNWVFALEKSVLKNEKLRRFY
EESQGGCEHRRCIDALRKASLVSEEEYEFLVHIRNKSAHNQFPDLEIGKLPPNVTSGFCECIWS
KYKAIICRIIPFIDPERRFFGKLLEQK >6 hypothetical protein [Alistipes sp. ZOR0009] (SEQ ID NO: 153)
MSNEIGAFREHQFAYAPGNEKQEEATFATYFNLALSNVEGMMFGEVESNPDKIEKSLDTLPPAI
LRQIASFIWLSKEDHPDKAYSTEEVKVIVTDLVRRLCFYRNYFSHCFYLDTQYFYSDELVDTTA
IGEKLPYNFHHFITNRLFRYSLPEITLFRWNEGERKYEILRDGLIFFCCLFLKRGQAERFLNEL
RFFKRTDEEGRIKRTIFTKYCTRESHKHIGIEEQDFLIFQDIIGDLNRVPKVCDGVVDLSKENE
RYIKNRETSNESDENKARYRLLIREKDKFPYYLMRYIVDFGVLPCITFKQNDYSTKEGRGQFHY
QDAAVAQEERCYNFVVRNGNVYYSYMPQAQNVVRISELQGTISVEELRNMVYASINGKDVNKSV
EQYLYHLHLLYEKILTISGQTIKEGRVDVEDYRPLLDKLLLRPASNGEELRRELRKLLPKRVCD
LLSNRFDCSEGVSAVEKRLKAILLRHEQLLLSQNPALHIDKIKSVIDYLYLFFSDDEKFRQQPT
EKAHRGLKDEEFQMYHYLVGDYDSHPLALWKELEASGRLKPEMRKLTSATSLHGLYMLCLKGTV
EWCRKQLMSIGKGTAKVEAIADRVGLKLYDKLKEYTPEQLEREVKLVVMHGYAAAATPKPKAQA
AIPSKLTELRFYSFLGKREMSFAAFIRQDKKAQKLWLRNFYTVENIKTLQKRQAAADAACKKLY
NLVGEVERVHTNDKVLVLVAQRYRERLLNVGSKCAVTLDNPERQQKLADVYEVQNAWLSIRFDD
LDFTLTHVNLSNLRKAYNLIPRKHILAFKEYLDNRVKQKLCEECRNVRRKEDLCTCCSPRYSNL
TSWLKENHSESSIEREAATMMLLDVERKLLSFLLDERRKAIIEYGKFIPFSALVKECRLADAGL
CGIRNDVLHDNVISYADAIGKLSAYFPKEASEAVEYIRRTKEVREQRREELMANSSQ >7 hypothetical protein [Prevotella sp. MA2016] (SEQ ID NO: 154)
MSKECKKQRQEKKRRLQKANFSISLTGKHVFGAYFNMARTNFVKTINYILPIAGVRGNYSENQI
NKMLHALFLIQAGRNEELTTEQKQWEKKLRLNPEQQTKFQKLLFKHFPVLGPMMADVADHKAYL
NKKKKSTVQTEDETFAMLKGVSLADCLDIICLMADTLTECRNFYTHKDPYNKPSQLADQYLHQEM
IAKKLDKVVVASRRILKDREGLSVNEVEFLTGIDHLHQEVLKDEFGNAKVKDGKVMKTFVEYDD
FYFKISGKRLVNGYTVTTKDDKPVNVNTMLPALSDFGLLYFCVLFLSKPYAKLFIDEVRLFEYS
PFDDKENMIMSEMLSIYRIRTPRLHKIDSHDSKATLAMDIFGELRRCPMELYNLLDKNAGQPFF
HDEVKHPNSHTPDVSKRLRYDDRFPTLALRYIDETELFKRIRFQLQLGSFRYKFYDKENCIDGR
VRVRRIQKEINGYGRMQEVADKRMDKWGDLIQKREERSVKLEHEELYINLDQFLEDTADSTPYV
TDRRPAYNIHANRIGLYWEDSQNPKQYKVFDENGMYIPELVVTEDKKAPIKMPAPRCALSVYDL
PAMLFYEYLREQQDNEFFSAEQVIIEYEDDYRKFFKAVAEGKLKPFKRPKEFRDFLKKEYPKLR
MADIPKKLQLFLCSHGLCYNNKPETVYERLDRLTLQHLEERELHIQNRLEHYQKDRDMIGNKDN
QYGKKSFSDVRHGALARYLAQSMMEWQPTKLKDKEKGHDKLTGLNYNVLTAYLATYGHPQVPEE
GFTPRTLEQVLINAHLIGGSNPHPFINKVLALGNRNIEELYLHYLEEELKHIRSRIQSLSSNPS
DKALSALPFIHHDRMRYHERTSEEMMALAARYTTIQLPDGLFTPYILEILQKHYTENSDLQNAL
SQDVPVKLNPTCNAAYLITLFYQTVLKDNAQPFYLSDKTYTRNKDGEKAESFSFKRAYELFSVL
NNNKKDTFPFEMIPLFLTSDEIQERLSAKLLDGDGNPVPEVGEKGKPATDSQGNTIWKRRIYSE
VDDYAEKLTDRDMKISFKGEWEKLPRWKQDKIIKRRDETRRQMRDELLQRMPRYIRDIKDNERT
LRRYKTQDMVLFLLAEKMFTNIISEQSSEFNWKQMRLSKVCNEAFLRQTLTFRVPVTVGETTIY
VEQENMSLKNYGEFYRLTDDRLMSLLNNIVETLKPNENGDLVIRHTDLMSELAAYDQYRSTIF
MLIQSIENLIITNNAVLDDPDADGFWVREDLPKRNNFASLLELINQLNNVELTDDERKLLVAIR
NAFSHSNYNIDFSLIKDVKHLPEVAKGILQHLQSMLGVEITK >8 hypothetical protein [Riemerella anatipestifer] (SEQ ID NO: 155)
MEKPLLPNVYTLKHKFFWGAFLNIARHNAFITICHINEQLGLKTPSNDDKIVDVVCETWNNILN
NDHDLLKKSQLTELILKHFPFLTAMCYHPFKKEGKKKGHQKEQQKEKESEAQSQAEALNPSKLI
EALEILVNQLHSLRNYYSHYKHKKPDAEKDIFKHLYKAFDASLRMVKEDYKAHFTVNLTRDFAH -continued
```
LNRKGKNKQDNPDFNRYRFEKDGFFTESGLLFFTNLFLDKRDAYWMLKKVSGFKASHKQREKMT
TEVFCRSRILLPKLRLESRYDHNQMLLDMLSELSRCPKLLYEKLSEENKKHFQVEADGFLDEIE
EEQNPFKDTLIRHQDRFPYFALRYLDLNESFKSIRFQVDLGTYHYCIYDKKIGDEQEKRHLTRT
LLSFGRLQDFTEINRPQEWKALTKDLDYKETSNQPFISKTTPHYHITDNKIGFRLGTSKELYPS
LEIKDGANRIAKYPYNSGFVAHAFISVHELLPLMFYQHLTGKSEDLLKETVRHIQRIYKDFEEE
RINTIEDLEKANQGRLPLGAFPKQMLGLLQNKQPDLSEKAKIKIEKLIAETKLLSHRLNTKLKS
SPKLGKRREKLIKTGVLADWLVKDFMRFQPVAYDAQNQPIKSSKANSTEFWFIRRALALYGGEK
NRLEGYFKQTNLIGNTNPHPFLNKFNWKACRNLVDFYQQYLEQREKFLEAIKNQPWEPYQYCLL
LKIPKENRKNLVKGWEQGGISLPRGLFTEAIRETLSEDLMLSKPIRKEIKKHGRVGFISRAITL
YFKEKYQDKHQSFYNLSYKLEAKAPLLKREEHYEYWQQNKPQSPTESQRLELHTSDRWKDYLLY
KRWQHLEKKLRLYRNQDVMLWLMTLELTKNHFKELNLNYHQLKLENLAVNVQEADAKLNPLNQT
LPMVLPVKVYPATAFGEVQYHKTPIRTVYIREEHTKALKMGNFKALVKDRRLNGLFSFIKEEND
TQKHPISQLRLRRELEIYQSLRVDAFKETLSLEEKLLNKHTSLSSLENEFRALLEEWKKEYAAS
SMVTDEHIAFIASVRNAFCHNQYPFYKEALHAPIPLFTVAQPTTEEKDGLGIAEALLKVLREYC
EIVKSQI >9 hypothetical protein [Prevotella aurantiaca] (SEQ ID NO: 156)
MEDDKKTTGSISYELKDKHFWAAFLNLARHVNYITINHINKLLEIREIDNDEKVLDIKTLWQKG
NKDLNQKARLRELMTKHFPPFLETAIYTKNKEDKKEVKQEKQAEAQSLESLKDCLFLFLDKLQEA
RNYYSHYKYSEFSKEPEFEEGLLEKMYNIFGNNIQLVINDYQHNKDINPDEDFKHLDRKGQFKY
SFADNEGNITESGLLFFVSLFLEKKDAIWMQQKLNGFKDNLENKKKMTHEVFCRSRILMPKLRL
ESTQTQDWILLDMLNELIRCPKSLYERLQGDDREKFKVPFDPADEDYNAEQEPFKNTLIRHQDR
FPYFVLRYFDYNEIFKNLRFQIDLGTYHFSIYKKLIGGQKEDRHLTHKLYGFERIQEFAKQNRP
DEWKAIVKDLDTYETSNKRYISETTPHYHLENQKIGIRFRNGNKEIWPSLKINDENNEKSKYKL
DKQYQAEAFLSVHELLPMMFYYLLLKKEKPNNDEINASIVEGFIKREIRNIFKLYDAFANGEIN
NIDDLEKYCADKGIPKRHLPKQMVAILYDEHKDMVKEAKRKQKEMVKDTKKLLATLEKQTQKEK
EDDGRNVKLLKSGEIARWLVNDMMRFQPVQKDNEGKPLNNSKANSTEYQMLQRSLALYNNEEKP
TRYFRQVNLIESNNPHPFLKWTKWEECNNILTFYYSYLTKKIEFLNKLKPEDWKKNQYFLKLKE
PKTNRETLVQGWKNGFNLPRGIFTEPIREWFKRHQNNSKEYEKVEALDRVGLVTKVIPLFFKEE
YFKDKEENFKEDTQKEINDCVQPFYNPPYNVGNIHKPKEKDFLHREERIELWDKKKDKFKGYKE
KIKSKKLTEKDKEEFRSYLEFQSWNKFERELRLVRNQDIVTWLLCKELIDKLKIDELNIEELKK
LRLNNIDTDTAKKEKNNILNRVMPMELPVTVYEIDDSHKIVDKPLHTIYIKEAETKLLKQGNF
KALVKDRRLNGLFSFVKINSEAESKRNPISKLRVEYELGEYQEARIEIIQDMLALEEKLINKYK
DLPINKFSEMLNSWLEGKDEADKARFQNDVDFLIAVRNAFSHNQYPMHNKIEFANIKPFSLYTA
NNSEEKGLGIANQLKDKTKETTDKIKKIEKPIETKE >10 hypothetical protein [Prevotella saccharolytica] (SEQ ID NO: 157)
MEDKPFWAAFFNLARHNVYLTVNHINKLLDLEKLYDEGKHKEIFEREDIFNISDDVMNDANSNG
KKRKLDIKKIWDDLDTDLTRKYQLRELILKHPPFIQPAIIGAQTKERTTIDKDKRSTSTSNDSL
KQTGEGDINDLLSLSNVKSMFFRLLQILEQLRNYYSHVKHSKSATMPNFDEDLLNWMRYIFIDS
VNKVKEDYSSNSVIDPNTSFSHLIYKDEQGKIKPCRYPFTSKDGSINAFGLLFFVSLFLEKQDS
IWMQKKIPGFKKASENYMKMTNEVFCRNHILLPKIRLETVYDKDWMLLDMLNEVVRCPLSLYKR
LTPAAQNKFKVPEKSSDNANRQEDDNPFSRILVRHQNRFPYFVLRFFDLNEVFTTLRFQINLGC
YHFAICKKQIGDKKEVHHLIRTLYGFSRLQNFTQNTRPEEWNTLVKTTEPSSGNDGKTVQGVPL
PYISYTIPHYQIENEKIGIKIFDGDTAVDTDIWPSVSTEKQLNKPDKYTLTPGFKADVFLSVHE
LLPMMFYYQLLLCEGMLKTDAGNAVEKVLIDTRNAIFNLYDAFVQEKINTITDLENYLQDKPIL
IGHLPKQMIDLLKGHQRDMLKAVEQKKAMLIKDTERRLKLLDKQLKQETDVAAKNTGTLLKNGQ
LADWLVNDMMRFQPVKRDKEGNPINCSKANSTEYQMLQRAFAFYATDSCRLSRYFTQLHLIHSD
NSHLFLSRFEYDKQPNLIAFYAAYLKAKLEFLNELQPQNWASDNYFLLLRAPKNDRQKLAEGWK
NGFNLPRGLFTEKIKTWFNEHKTIVDISDCDIFKNRVGQVARLIPVFFDKKFKDHSQPFYRYDF
NVGNVSKPTEANYLSKGKREELFKSYQNKFKNNIPAEKTKEYREYKNFSLWKKFERELRLIKNQ
DILIWLMCKNLFDEKIKPKKDILEPRIAVSYIKLDSLQTNTSTAGSLNALAKVVPMTLAIHIDS
PKPKGKAGNNEKENKEFTVYIKEEGTKLLKWGNFKILLADRRIKGLFSYIEHDDIDLKQHPLIK
RRVDLELDLYQTCRIDIFQQTLGLEAQLLDKYSDLNTDNFYQMLIGWRKKEGIPRNIKEDTDFL
KDVRNAFSHNQYPDSKKIAFRRIRKFNPKELILEEEGLGIATQMYKEVEKVVNRIKRIELFD >11 hypothetical protein [Myroides odoratimimus] (SEQ ID NO: 158)
MKDILTTDTTEKQNRFYSHKIADKYFFGGYFNLASNNIYEVFEEVNKRNTFGKLAKRDNGNLKN
YIIHVFKDELSISDFEKRVAIFASYFPILETVDKKSIKERNRTIDLTLSQRIRQFREMLISLVT
AVDQLRNFYTHYHHSDIVIENKVLDFLNSSFVSTALHVKDKYLKTDKTKEFLKETIAAELDILI
EAYKKKQIEKKNTRFKANKREDILNAIYNEAFWSFINDKDKDKDKETVVAKGADAYFEKNHHKS
NDPDFALNISEKGIVYLLSFFLTNKEMDSLKANLTGFKGKVDRESGNSIKYMATQRIYSFHTYR
GLKQKIRTSEEGVKETLLMQMIDELSKVPNVVYQHLSTTQQNSFIEDWNEYYKDYEDDVETEDL
SRVIHPVIRKRYEDRFNYFAIRFLDEFFDFPTLRFQVHLGDYVHDRRTKQLGKVESDRIIKEKV
TVFARLKDINSAKASYFHSLEEQDKEELDNKWILFPNPSYDFPKEHTLQHQGEQKNAGKIGIYV
KLRDTQYKEKAALEEARKSLNPKERSATKASKYDIITQIIEANDNVKSEKPLVFTGQPIAYLSM
NDIHSMLFSLLTDNAELKKTPEEVEAKLIDQIGKQINEILSKDTDTKILKKYKDNDLKETDTDK
ITRDLARDKEEIEKLILEQKQRADDYNYTSSTKFNIDKSRRKRKHLLFNAEKGKIGVWLANDIKR
FMFKESKSKWKGYQHTELQKLFAYFDTSKSDLELILSNMVMVKDYPIELIDLVKKSRTLVDFLN
KYLEARLEYIENVITRVKNSIGTPQFKTVRKECFTFLKKSNYTVVSLDKQVERILSMPLFIERG
FMDDKPTMLEGKSYKQHKEKFADWFVHYKENSNYQNFYDTEVYEITTEDKREKAKVTKKIKQQQ
KNDVFTLMMVNYMLEEVLKLSSNDRLSLNELYQTKEERIVNKQVAKDTQERNKNYIWNKVVDLQ
LCDGLVHIDNVKLKDIGNFRKYENDSRVKEFLTYQSDIVWSAYLSNEVDSNKLYVIERQLDNYE
SIRSKELLKEVQEIECSVYNQVANKESLKQSGNENFKQYVLQGLLPIGMDVREMLILSTDVKFK
KEEIIQLGQAGEVEQDLYSLIYIRNKFAHNQLPIKEFFDFCENNYRSISDNEYYAEYYMEIFRS
IKEKYAN >12 hypothetical protein [Flavobacterium columnare] (SEQ ID NO: 159)
MSSKNESYNKQKTFNHYKQEDKYFFGGFLNNADDNLRQVGKEFKTRINFNHNNNELASVFKDYF
NKEKSVAKREHALNLLSNYFPVLERIQKHTNHNFEQTREIFELLLDTIKKLRDYYTHHHYHKPIT
INPKIYDFLDDTLLDVLITIKKKKVKNDTSRELLKEKLRPELTQLKNQKREELIKKGKKLLEEN
```

-continued
LENAVFNHCLRPPFLEENKTDDKQNKTVSLRKYRKSKPNEETSITLTQSGLVFLMSFFLHRKEFQ
VFTSGLEGFKAKVNTIKEEEISLNKNNIVYMITHWSYSYYNFKGLKHRIKTDQGVSTLEQNNTT
HSLTNTNTKEALLTQIVDYLSKVPNEIYETLSEKQQKEFEEDINEYMRENPENEDSTFSSIVSH
KVIRKRYENKFNYFAMRFLDEYAELPTLRFMVNFGDYIKDRQKKILESIQFDSERIIKKEIHLF
EKLSLVTEYKKNVYLKETSNIDLSRFPLFPNPSYVMANNNIPFYIDSRSNNLDEYLNQKKKAQS
QNKKRNLTFEKYNKEQSKDAIIAMLQKEIGVKDLQQRSTIGLLSCNELPSMLYEVIVKDIKGAE
LENKIAQKIREQYQSIRDFTLDSPQKDNIPTTLIKTINTDSSVTFENQPIDIPRLKNAIQKELT
LTQEKLLNVKEHEIEVDNYNRNKNTYKFKNQPKNKVDDKKLQRKYVFYRNEIRQEANWLASDLI
HPFMKNKSLWKGYMHNELQSFLAFFEDKKNDCIALLETVFNLKEDCILTKGLKNLFLKHGNFIDF
YKEYLKLKEDFLNTESTFLENGLIGLPPKILKKELSKRFKYIFIVFQKRQFIIKELEEKKNNLY
ADAINLSRGIFDEKPTMIPFKKPNPDEFASWFVASYQYNNYQSFYELTPDIVERDKKKKYKNLR
AINKVKIQDYYLKLMVDTLYQDLFNQPLDKSLSDFYVSKAEREKIKADAKAYQKRNDSSLWNKV
IHLSLQNNRITANPKLKDIGKYKRALQDEKIATLLTYDDRTWTYALQKPEKENENDYKELHYTA
LNMELQEYEKVRSKELLKQVQELEKQILEEYTDFLSTQIHPADFEREGNPNFKKYLAHSILENE
DDLDKLPEKVEAMRELDETITNPIIKKAIVLIIRNKMAHNQYPPKFIYDLANRFVPKKEEEYF
ATYFNRVFETITKELWENKEKKDKTQV >13 hypothetical protein [Bacteroides pyogenes] (SEQ ID NO: 160)
MALLNVRKVENHIRKWLGDVALLPEKSGFHSLLTTDNLSSAKWTRFYYKSRKFLPFLEMFDSDK
KSYENRRETTECLDTIDRQKISSLLKEVYGKLQDIRNAFSHYHIDDQSVKHTALIISSEMHRFI
ENAYSFALQKTRARFTGVFVETDFLQAEEKGDNKKFFAIGGNEGIKLKDNALIFLICLFLDREE
APKFLSRATGFKSTKEKGFLAVRETFCALCCRQPHERLLSVNPREALLMDMLNELNRCPDILFE
MLDEKDQKSFLPLLGEEEQAHILENSLNDELCEAIDDPFEMIASLSKRVRYKNRFPYLMLRYIE
EKNLLPFIRFRIDLGCLELASYPKKMGEENNYERSVTDHAMAFGRLTDFHNEDAVLQQITKGIT
DEVRFSLYAPRYAIYNNKIGFVRTGGSDKISFPTLKKKGGEGHCVAYTLQNTKSFGFISIYDLR
KILLLSFLDKDKAKNIVSGLLEQCEKHWKDLSENLFDAIRTELQKEFPVPLIRYTLPRSKGGKL
VSSKLADKQEKYESEFERRKEKLTEILSEKDFDLSQIPRRMIDEWLNVLPTSREKKLKGYVETL
KLDCRERLRVFEKREKGEHPVPPRIGEMATDLAKDIIRMVIDQGVKQRITSAYYSEIQRCLAQY
AGDDNRRHLDSIIRELRLKDTKNGHPFLGKVLRPGLGHTEKLYQRYFEEKKEWLEATFYPAASP
KRVPRFVNPPTGKQKELPLIIRNLMKERPEWRDWKQRKNSHPIDLPSQLFENEICRLLKDKIGK
EPSGKLKWNEMFKLYWDKEFPNGMQRFYRCKRRVEVFDKVVEYEYSEEGGNYKKYYEALIDEVV
RQKISSSKEKSKLQVEDLTLSVRRVFKRAINEKEYQLRLLCEDDRLLFMAVRDLYDWKEAQLDL
DKIDNMLGEPVSVSQVIQLEGGQPDAVIKAECKLKDVSKLMRYCYDGRVKGLMPYFANHEATQE
QVEMELRHYEDHRRRVFNWVFALEKSVLKNEKLRRFYEESQGGCEHRRCIDALRKASLVSEEEY
EFLVHIRNKSAHNQFPDLEIGKLPPNVISGFCECIWSKYKAIICRIIPFIDPERRFFGKLLEQK >14 hypothetical protein [Capnocytophaga canimorsus] (SEQ ID NO: 161)
MKNIQRLGKGNEFSPFKKEDKFYFGGFLNLANNNIEDFFKEIITRFGIVITDENKKPKETFGEK
ILNEIFKKDISIVDYEKWVNIFADYFPFTKYLSLYLEEMQFKNVICFRDVMKELLKTVEALRN
FYTHYDHEPIKIEDRVFYFLDKVLLDVSLTVKNKYLKTDKTKEFLNQHIGEELKELCKQRKDYL
VGKGKRIDKESEIINGIYNNAFKDFICKREKQDDKENHNSVEKILCNKEPQNKKQKSSATVWEL
CSKSSSKYTEKSFPNRENDKHCLEVPISQKGIVFLLSFFLNKGEIYALTSNIKGFKAKITKEEP
VTYDKNSIRYMATHRMFSFLAYKGLKRKIRTSEINYNEDGQASSTYEKETLMLQMLDELNKVPD
VVYQNLSEDVQKTFIEDWNEYLKENNGDVGTMEEEQVIHPVIRKRYEDKFNYFAIRFLDEFAQF
PTLRFQVHLGNYLCDKRTKQICDTTTEREVKKKITVFGRLSELENKKAIFLNEREEIKGWEVFP
NPSYDFPKENISVNYKDFPIVGSILDREKQPVSNKIGIRVKIADELQREIDKAIKEKKLRNPKN
RKANQDEKQKERLVNEIVSTNSNEQGEPVVFIGQPTAYLSMNDIHSVLYEFLINKISGEALETK
IVEKIETQIKQIIGKDATTKILKPYTNANSNSINREKLLRDLEQEQQILKTLLEEQQQREKDKK
DKKSKRKHELYPSEKGKVAVWLANDIKRFMPKAFKEQWRGYHHSLLQKYLAYYEQSKEELKNLL
PKEVFKHFPFKLKGYFQQQYLNQFYTDYLKRRLSYVNELLLNIQNFKNDKDALKATEKECFKFF
RKQNYIINPINIQIQSILVYPIFLKRGFLDEKPTMIDREKFKENKDTELADWFMHYKNYKEDNY
QKFYAYPLEKVEEKEKFKRNKQINKQKKNDVYTLMMVEYIIQKIFGDKFVEENPLVLKGIFQSK
AERQQNNTHAATTQERNLNGILNQPKDIKIQGKITVGVKLKDIGNFRKYEIDQRVNTFLDYEP
RKEWMAYLPNDWKEKEKQGQLPPNNVIDRQISKYETVRSKILLKDVQELEKIISDEIKEEHRHD
LKQGKYYNFKYYILNGLLRQLKNENVENYKVFKLNINPEKVNITQLKQEATDLEQKAFVLTYIR
NKFAHNQLPKKEFWDYCQEKYGKIEKEKTYAEYFAEVFKREKEALIK >15 hypothetical protein [Capnocytophaga cynodegmi] (SEQ ID NO: 162)
MENKTSLGNNIYYNPFKPQDKSYFAGYLNAAMENIDSVFRELGKRLKGKEYTSENFFDAIFKEN
ISLVEYERYVKLLSDYFPMARLLDKKEVPIKERKENFKKNFRGIIKAVRDLRNFYTHKEHGEVE
ITDEIFGVLDEMLKSTVLTVKKKKIKTDKTKEILKKSIEKQLDILCQKKLEYLKDTARKIEEKR
RNQRERGEKKLVPRFEYSDRRDDLIAAIYNDAFDVYIDKKKDSLKESSKTKYNTESYPQQEEGD
LKIPISKNGVVFLLSLFLSKQEVHAFKSKIAGFKATVIDEATVSHRKNSICFMATHEIFSHLAY
KKLRKVRTAEINYSEAENAEQLSIYAKETLMMQMLDELSKVPDVVYQNLSEDVQKTFIEDWNE
YLKENNGDVGTMEEEQVIHPVIRKRYEDKFNYFAIRFLDEFAQFPTLRFQVHLGNYLHDSRPKE
HLISDRRIKEKITVFGRLSELEHKKALFIKNTETNEDRKHYWEVFPNPNYDFPKENISVNDKDF
PIAGSILDREKQPTAGKIGIKVNLLNQKYISEVDKAVKAHQLKQRNNKPSIQNIIEEIVPINGS
NPKEIIVFGGQPTAYLSMNDIHSILYEFFDKWEKKKEKLEKKGEKELRKEIGKELEEKIVGKIQ
TQIQQIIDKDINAKILKPYQDDDSTAIDKEKLIKDLKQEQKILQKLKNEQTAREKEYQECIAYQ
EESRKIKRSDKSRQKYLRNQLKRKYPEVPTRKEILYYQEKGKVAVWLANDIKRFMPTDFKNEWK
GEQHSLLQKSLAYYEQCKEELKNLLPQQKVFKHLPFELGGHFQQKYLYQFYTRYLDKRLEHISG
LVQQAENFKNENKVFKKVENECFKLKKQNYTHKGLDAQAQSVLGYPIFLERGFMDEKPTIIKG
KTFKGNESLFTDWFRYYKEYQNFQTFYDTENYPLVELEKKQADRKRETKIYQQKKNDVFTLLMA
KHIFKSVFKQDSIDRFSLEDLYQSREERLENQEKAKQTGERNTNYIWNKTVDLNLCDGKVTVEN
VKLKNVGNFIKYEYDQRVQTFLKYEENIKWQAFLIKESKEEENYPYIVEREIEQYEKVRREELL
KEVHLIEEYILEKVKDKEILKKGDNQNFKYYILNGLLKQLKNEDVESYKVFNLNTKPEDVNINQ
LKQEATDLEQKAFVLTYIRNKFAHNQLPKKEFWDYCQEKYGKIEKEKTYAEYFAEVFKREKEAL
MK >16 hypothetical protein [Chryseobacterium sp. YR477] (SEQ ID NO: 163)
METQTIGHGIAYDHSKIQDKHFFGGFLNLAENNIKAVLKAFSEKFNVGNVDVKQFADVSLKDNL -continued

```
PDNDFQKRVSFLKMYFPVVDFINIPNNRAKFRSDLTTLFKSVDQLRNFYTHYYHKPLDFDASLF
ILLLDDIFARTAKEVRDQKMKDDKTRQLLSKSLSEELQKGYELQLERLKELNRLGKKVNIHDQLG
IKNGVLNNAFNHLIYKDGESFKTKLTYSSALTSFESAENGIEISQSGLLFLLSMFLKRKEIEDL
KNRNKGFKAKVVIDEDGKVNGLKFMATHWVFSYLCFKGLKSKLSTEFHEETLLIQIIDELSKVP
DELYCAFDKETRDKFIEDINEYVKEGHQDFSLEDAKVIHPVIRKRYENKFNYFAIRFLDEFVKF
PSLRFQVHVGNYVHDRRIKNIDGTTFETERVVKDRIKVFGRLSEISSYKAQYLSSVSDKHDETG
WEIFPNPSYVFINNNIPIHISVDTSFKKEIADFKKLRRAQVPDELKIRGAEKKRKFEITQMIGS
KSVLNQEEPIALLSLNEIPALLYEILINGKEPAEIERIIKDKLNERQDVIKNYNPENWLPASQI
SRRLRSNKGERIINTDKLLQLVTKELLVTEQKLKIISDNREALKQKKEGKYIRKFIFTNSELGR
EAIWLADDIKRFMPADVRKEWKGYQHSQLQQSLAFYNSRPKEALAILESSWNLKDEKIIWNEWI
LKSFTQNKFFDAFYNEYLKGRKKYFAFLSEHIVQYTSNAKNLQKFIKQQMPKDLFEKRHYIIED
LQTEKNKILSKPFIFPRGIFDKKPTFIKGVKVEDSPESFANWYQYGYQKDHQFQKFYDWKRDYS
DVFLEHLGKPFINNGDRRTLGMEELKERIIIKQDLKIKKKIQDLFLRLIAENLFQKVFKYSAK
LPLSDFYLTQEERMEKENMAALQNVREEGDKSPNIIKDNFIWSKMIPYKKGQIIENAVKLKDIG
KLNVLSLDDKVQTLLSYDDAKPWSKIALENEFSIGENSYEVIRREKLFKEIQQFESEILFRSGW
DGINHPAQLEDNRNPKFKMYIVNGILRKSAGLYSQGEDIWFEYNADFNNLDADVLETKSELVQL
AFLVTAIRNKFAHNQLPAKEFYFYIRAKYGFADEPSVALVYLNFTKYAINEFKKVMI

>17 hypothetical protein [Phaeodactylibacter xiamenensis]
(SEQ ID NO: 164)
MTNTPKRRTLHRHPSYFGAFLNIARHNAFMIMEHLSTKYDMEDKNTLDEAQLPNAKLFGCLKKR
YGKPDVTEGVSRDLRRYFPFLNYPLFLHLEKQQNAEQAATYDINPEDIEFTLKGFFRLLNQMRN
NYSHYISNTDYGKFDKLPVQDIYEAAIFRLLDRGKHTKRFDVFESKHTRHLESNNSEYRPRSLA
NSPDHENTVAFVTCLFLERKYAFPFLSRLDCFRSTNDAAEGDPLIRKASHECYTMFCCRLPQPK
LESSDILLDMVNELGRCPSALYNLLSEEDQARFHIKREEITGFEEDPDEELEQEIVLKRHSDRF
PYFALRYFDDTEAFQTLRFDVYLGRWRTKPVYKKRIYGQERDRVLTQSIRTFTRLSRLLPIYEN
VKHDAVRQNEEDGKLVNPDVTSQFHKSWIQIESDDRAFLSDRIEHFSPHYNFGDQVIGLKFINP
DRYAAIQNVFPKLPGEEKKDKDAKLVNETADAIISTHEIRSLFLYHYLSKKPISAGDERRFIQV
DTETFIKQYIDTIKLFFEDIKSGELQPIADPPNYQKNEPLPYVRGDKEKTQEERAQYRERQKEI
KERRKELNTLLQNRYGLSIQYIPSRLREYLLGYKKVPYEKLALQKLRAQRKEVKRKRIKDIEKMR
TPRVGEQATWLAEDIVFLIPPKMHTPERKTTKHPQKLNNDQFRIMQSSLAYFSVNKKAIKKFFQ
KETGIGLSNRETSHPFLYRIDVGRCRGILDFYTGYLKYKMDWLDDAIKKVDNRKHGKKEAKKYE
KYLPSSIQHKTPLELDYTRLPVYLPRGLFKKAIVKALAAHADFQVEPEEDNVIFCLDQLLDGDT
QDFYNWQRYYRSALTEKETDNQLVLAHPYAEQILGTIKTLEGKQKNNKLGNKAKQKIKDELIDL
KRAKRRLLDREQYLRAVQAEDRALWLMIQERQKQKAEHEEIAFDQLDLKNITKILTESIDARLR
IPDTKVDITDKLPLRRYGDLRRVAKDRRLVNLASYYHVAGLSEIPYDLVKKELEEYDRRRVAFF
EHVYQFEKEVYDRYAAELRNENPKGESTYFSHWEYVAVAVKHSADTHFNELFKEKVMQLRNKFH
HNEFPYFDWLLPEVEKASAALYADRVFDVAEGYYQKMRKLMRQ >18 hypothetical protein [Porphyromonas gingivalis] (SEQ ID NO: 165)
MTEQNEKPYNGTYYTLEDKHFWAAFFNLARHNAYITLTHIDRQLAYSKADITNDEDILFFKGQW
KNLDNDLERKARLRSLILKHFSFLEGAAYGKKLFESQSSGNKSSKKKELTKKEKEELQANALSL
DNLKSILFDFLQKLKDFRNYYSHYRHPESSELPLFDGNMLQRLYNVFDVSVQRVKRDHEHNDLV
DPHRHFNHLVRKGKKDRCGNNDNPFFKHHFVDREGKVTEAGLLFFVSLFLEKRDAIWMQKKIRG
FKGGTETYQQMTNEVFCRSRISLPKLKLESLRTDDWMLLDMLNELVRCPKSLYDRLREEDRACF
RVPVDILSDEDDTDGAEEDPFKNTLVRHQDRFPYFALRYFDLKKVFTSLRFHIDLGTYHFAIYK
KNIGEQPEDRHLTRNLYGFGRIQDFAEEHRPEEWKRLVRDLDCFETGDKPYITQTTPHYHIEKG
KIGLRFVFEGQHLWPSPEVGATRTGRSKYAQDKRLTAEAFLSVHELMPMMFYYFLLREKYSDEA
SAERVQGRIKRVIEDVYAVYDAFARGEIDTLDRLDACLADKGIRRGHLPRQIIAILSQEHKDME
EKVRKKLQEMIADTDHRLDMLDRQTDRKIRIGRKNAGLPKSGVIADWLVRDMMRFQPVAKDTSG
KPLNNSKANSTEYRMLQRALALFGGEKERLTPYFRQMNLTGGNNPHPFLHETRWESHTNILSFY
RSYLKARKAFLQSIGRSDRVENHRFLLLKEPKTDRQTLVAGWKGEFHLPRGIFTEAVRDCLIEM
GHDEVASYKEVGFMAKAVPLYFERACKDRVQPFYDYPFNVGNSLKPKKGRFLSKEKRAEEWESG
KERFRDLEAWSHSAARRIEDAFVGIEYASWENKKKIEQLLQDLSLWETFESKLKVKADKINIAK
LKKEILEAKEHPYHDFKSWQKFERELRLVKNQDIITWMMCRDLMEENKVEGLDTGTLYLKDIRT
DVHEQGSLNVLNRVKPMRLPVVVYRADSRGHVHKEEAPLATVYIEERDTKLLKQGNFKSFVKDR
RLNGLFSFVDTGGLAMEQYPISKLRVEYELAKYQTARVCAFEQTLELEESLLTRYPHLPDKNFR
KMLESWSDPLLDKWPDLHRKVRLLIAVRNAFSHNQYPMYDEAVFSSIRKYDPSSLDAIEERMGL
NIAHRLSEEVKQAKETVERIIQA >19 hypothetical protein [Porphyromonas gulae] (SEQ ID NO: 166)
MNTVPATENKGQSRTVEDDPQYFGLYLNLARENLIEVESHVRIKFGKKKLNEESLKQSLLCDHL
LSIDRWTKVYGHSRRYLPFLHCFDPDSGIEKDHDSKTGVDPDSAQRLIRELYSLLDFLRNDFSH
NRLDGTTFEHLKVSPDISSFITGAYTFACERAQSRFADFFKPDDFLLAKNRKEQLISVADGKEC
LTVSGFAFFICLFLDREQASGMLSRIRGFKRTDENWARAVHETFCDLCIRHPHDRLESSNTKEA
LLLLDMLNELNRCPRILYDMLPEEERAQFLPALDENSMNNLSENSLNEESRLLWDGSSDWAEALT
KRIRHQDRFPYLMLRFIEEMDLLKGIRFRVDLGEIELDSYSKKVGRNGEYDRTITDHALAFGKL
SDFQNEEEVSRMISGEASYPVRFSLFAPRYAIYDNKIGYCHTSDPVYPKSKTGEKRALSNPQSM
GFISVHDLRKLLLMELLCEGSFSRMQSDFLRKANRILDETAEGKLQFSALFPEMRHRFIPPQNP
KSKDRREKAETTLEKYKQEIKGRKDKLNSQLLSAFDMNQRQLPSRLLDEWMNIRPASHSVKLRT
YVKQLNEDCRLRLRKFRKDGDGKARAIPLVGEMATFLSQDIVRMIISEETKKLITSAYYNEMQR
SLAQYAGEENRRQFRAIVAELHLLDPSSGHPFLSATMETAHRYTEDFYKCYLEKKREWLAKTFY
RPEQDENTKRRISVFFVPDGEARKLLPLLIRRRMKEQNDLQDWIRNKQAHPIDLPSHLFDSKIM
ELLKVKDGKKKWNEAFKDWWSTKYPDGMQPFYGLRRELNIHGKSVSYIPSDGKKFADCYTHLME
KTVRDKKRELRTAGKPVPPDLAAYIKRSFHRAVNEREFMLRLVQEDDRLMLMAINKMMTDREED
ILPGLKNIDSILDEENQFSLAVHAKVLEKEGEGGDNSLSLVPATIEIKSKRKDWSKYIRYRYDR
RVPGLMSHFPEHKATLDEVKILLGEYDRCRIKIFDWAFALEGAIMSDRDLKPYLHESSSREGKS
GEHSTLVKMLVEKKGCLTPDESQYLILIRNKAAHNQFPCAAEMPLIYRDVSAKVGSIEGSSAKD
LPEGSSLVDSLWKKYEMIIRKLPILDHENRFFGKLLNNMSQPINDL
```

-continued

>20 hypothetical protein [*Porphyromonas gulae*] (SEQ ID NO: 167)
MTEQSERPYNGTYYTLEDKHFWAAFLNLARHNAYITLTHIDRQLAYSKADITNDQDVLSFKALW
KNFDNDLERKSRLRSLILKHFSFLEGAAYGKKLFESKSSGNKSSKNKELTKKEKEELQANALSL
DNLKSILFDFLQKLKDFRNYYSHYRHSGSSELPLFDGNMLQRLYNVFDVSVQRVKIDHEHNDEV
DPHYHFNHLVRKGKKDRYGHNDNPSFKHHFVDGEGMVTEAGLLFFVSLFLEKRDAIWMQKKIRG
FKGGTETYQQMTNEVFCRSRISLPKLKLESLRMDDWMLLDMLNELVRCPKPLYDRLREDDRACF
RVPVDILPDEDDTDGGGEDPFKNTLVRHQDRFPYFALRYFDLKKVFTSLRFHIDLGTYHFAIYK
KMIGEQPEDRHLTRNLYGFGRIQDFAEEHRPEEWKRLVRDLLDYFETGDKPYISQTSPHYHIEKG
KIGLRFMPEGQHLWPSPEVGTTRTGRSKYAQDKRLTAEAFLSVHELMPMMFYYFLLREKYSEEV
SAERVQGRIKRVIEDVYAVYDAFARDEINTRDELDACLADKGIRRGHLPRQMIAILSQEHKDME
EKIRRKLQEMMADTDHRLDMLDRQTDRKIRIGRKNAGLPKSGVIADWLVRDMMRFQPVAKDASG
KPLNNSKANSTEYRMLQRALALFGGEKERLTPYFRQMNLTGNNPHPFLHETRWESHTNILSFY
RSYLRARKAFLERIGRSDRVENRPFLLLKEPKTDRQTLVAGWKGEFHLPRGIFTEAVRDCLIEM
GHDEVASYKEVGFMAKAVPLYFERACEDRVQPFYDSPFNVGNSLKPKKGRFLSKEERAEEWERG
KERFRDLEAWSYSAARRIEDAFAGIEYASPGNKKKIEQLLRDLSLWEAFESKLKVRADRINLAK
LKKEILEAQEHPYHDFKSWQKFERELRLVKNQDIITWMMCRDLMEENKVEGLDTGTLYLKDIRP
NVQEQGSLNVLNRVKPMRLPVVVYRADSRGHVHKEEAPLATVYIEERDTKLLKQGNFKSFVKDR
RLNGLFSFVDTGGLAMEQYPISKLRVEYELAKYQTARVCVFELTLRLEESLLTRYPHLPDESFR
EMLESWSDPLLAKWPELHGKVRLLIAVRNAFSHNQYPMYDEAVFSSIRKYDPSSPDAIEERMGL
NIAHRLSEEVKQAKETVERIIQA >21 hypothetical protein [*Porphyromonas gulae*] (SEQ ID NO: 168)
MTEQSERPYNGTYYTLEDKHFWAAFLNLARHNAYITLTHIDRQLAYSKADITNDQDVLSFKALW
KNLDNDLERKSRLRSLILKHFSFLEGAAYGKKLFESKSSGNKSSKNKELTKKEKEELQANALSL
DNLKSILFDFLQKLKDFRNYYSHYRHSGSSELPLFDGNMLQRLYNVFDVSVQRVKRDHEHNDKV
DPHRHFNHLVRKGKKDRYGHNDNPSFKHHFVDGEGMVTEAGLLFFVSLFLEKRDAIWMQKKIRG
FKGGTETYQQMTNEVFCRSRISLPKLKLESLRTDDWMLLDMLNELVRCPKPLYDRLREKDRARF
RVPVDILPDEDDTDGGGEDPFKNTLVRHQDRFPYFALRYFDLKKVFTSLRFHIDLGTYHFAIYK
KVIGEQPEDRHLTRNLYGFGRIQDFAEEHRPEEWKRLVRDLLDYFETGDKPYISQTTPHYHIEKG
KIGLRFVFEGQHLWPSPEVGTTRTGRSKYAQDKRLTAEAFLSVHELMPMMFYYFLLREKYSEEV
SAEKVQGRIKRVIEDVYAIYDAFARDEINTRDELDACLADKGIRRGHLPKQMIGILSQEHKNME
EKVRRKLQEMIADTDHRLDMLDRQTDRKIRIGRKNAGLPKSGVIADWLVRDMMRFQPVAKDTSG
KPLNNSKANSTEYRMLQRALALFGGEKERLTPYFRQMNLTGNNPHPFLDETRWESHTNILSFY
RSYLRARKAFLERIGRSDRVENRPFLLLKEPKTDRQTLVAGWKSEFHLPRGIFTEAVRDCLIEM
GYDEVGSYKEVGFMAKAVPLYFERACKDRVQPFYDSPFNVGNSLKPKKGRFLSKEKRAEEWESG
KERFRLAKLKKEILEAQEHPYHDFKSWQKFERELRLVKNQDIITWMMCRDLMEENKVEGLDTGT
LYLKDIRPNVQEQGSLNVLNRVKPMRLPVVVYRADSRGHVHKEEAPLATVYIEERDTKLLKQGN
FKSFVKDRRLNGLFSFVDTGGLAMEQYPISKLRVEYELAKYQTARVCVFELTLRLEESLLSRYP
HLPDESFREMLESWSDPLLAKWPELHGKVRLLIAVRNAFSHNQYPMYDEAVFSSIRKYDPSSPD
AIEERMGLNIAHRLSEEVKQAKETVERIIQA >22 hypothetical protein [*Prevotella falsenii*] (SEQ ID NO: 169)
MKNDNNSTKSTDYTLGDKHFWAAFLNLARHNVYITVNHINKVLELKNKKDQEIIIDNDQDILAI
KTLWGKVDTDINKKDRLRELIMKHFPFLEAATYQQSSTNNTKQEEEQAKAQSFESLKDCLFLF
LEKLREARNYYSHYKHSKSLEEPKLEEKLLENMYNIFDTNVQLVIKDYEHNKDINPEEDFKHLG
RAEGEFNYYFTRNKKGNITESGLLFFVSLFLEKKDAIWAQTKIKGFKDNRENKQKMTHEVFCRS
RMLLPKLRLESTQTQDWILLDMLNELIRCPKSLYKRLQGEKREKFRVPFDPADEDYDAEQEPFK
NTLVRHQDRFPYFALRYFDYNEIFTNLRFQIDLGTYHFSIYKKQIGDKKEDRHLTHKLYGFERI
QEFAKENRPDEWKALVKDLDTFEESNEPYISETTPHYHLENQKIGIRNKNKKKKTIWPSLETK
TIVNERSKYNLGKSFKAEAFLSVHELLPMMFYYLLLNKEEPNNGKINASKVEGIIEKKIRDIYK
LYGAFANEEINNEEELKEYCEGKDIAIRHLPKQMIAILKNEYKDMAKKAEDKQKKMIKDTKKRL
AALDKQVKGEVEDGGRNIKPLKSGRIASWLVNDMMRFQPVQRDRDGYPLNNSKANSTEYQLLQR
TLALFGSERERLAPYFRQMNLIGKDNPHPFLKDTKWKEHNNILSFYRSYLEAKKNFLGSLKPED
WKKNQYFLKLKEPKTNRETLVQGWKNGFNLPRGIFTEPIREWFIRHQNESEEYKKVKDFDRIGL
VAKVIPLFFKEDYQKEIEDYVQPFYGYPFNVGNIHNSQEGTFLNKKEREELWKGNKTKFKDYKT
KEKNKEKTNKDKFKKKTDEEKEEFRSYLDFQSWKKFERELRLVRNQDIVTWLLCMELIDKLKID
ELNIEELQKLRLKDIDTDTAKKEKNNILNRIMPMELPVTVYETDDSNNIIKDKPLHTIYIKEAE
TKLLKQGNFKALVKDRRLNGLFSFVETSSEAELKSKPISKSLVEYELGEYQRARVEIIKDMLRL
EETLIGNDEKLPTNKFRQMLDKWLEHKKETDDTDLKNDVKLLTEVRNAFSHNQYPMRDRIAFAN
IKPFSLSSANTSNEEGLGIAKKLKDKTKETIDRIIEIEEQTATKR >23 hypothetical protein [*Prevotella intermedia*] (SEQ ID NO: 170)
MEDDKKTKESTNMLDNKHFWAAFLNLARHNVYITVNHINKVLELKNKKDQDIIIDNDQDILAIK
THWEKVNGDLNKTERLRELMTKHFPFLETAIYTKNKEDKEEVKQEKQAKAQSFDSLKHCLFLFL
EKLQEARNYYSHYKYSESTKEPMLEKELLKKMYNIFDDNIQLVIKDYQHNKDINPDEDFKHLDR
TEEEFNYYFTTNKKGNITASGLLFFVSLFLEKKDAIWMQQKLRGFKDNRESKKKMTHEVFCRSR
MLLPKLRLESTQTQDWILLDMLNELIRCPKSLYERLQGEYRKKFNVPFDSADEDYDAEQEPFKN
TLVRHQDRFPYFALRYFDYNEIFTNLRFQIDLGTYHFSIYKKLIGGQKEDRHLTHKLYGFERIQ
EFAKQNRTDEWKAIVKDFDTYETSEEPYISETAPHYHLENQKIGIRFRNDNDEIWPSLKTNGEN
NEKRKYKLDKQYQAEAFLSVHELLPMMFYYLLLKKEEPNNDKKNASIVEGFIKREIRDIYKLYD
AFANGEINNIDDLEKYCEDKGIPKRHLPKQMVAILYDEHKDMAEEAKRKQKEMVKDTKKLLATL
EKQTQGEIEDGGRNIRLLKSGEIARWLVNDMMRFQPVQKDNEGNPLNNSKANSTEYQMLQRSLA
LYNKEEKPTRYFRQVNLINSSNPHPFLKWTKWEECNNILSFYRSYLTKKIEFLNKLKPEDWEKN
QYFLKLKEPKTNRETLVQGWKNGFNLPRGIFTEPIREWFKRHQNDSEEYEKVETLDRVGLVTKV
IPLFFKKEDSKKEEYLKKDAQKEINNCVQPFYGFPYNVGNIHKPDEKDFLPSEERKKLWGDKK
YKFKGYKAKVKSKKLTDKEKEEYRSYLEFQSWNKFERELRLVRNQDIVTWLLCTELIDKLKVEG
LNVEELKKLRLKDIDTDTAKQEKNNILNRVMPMQLPVTVYEIDDSHNIVKDRPLHTVYIEETKT
KLLKQGNFKALVKDRRLNGLFSFVDTSSETELKSNPISKSLVEYELGEYQNARIETIKDMLLLE
ETLIEKYKTLPTDNFSDMLNGWLEGKDEADKARFQNDVKLLVAVRNAFSHNQYPMRNRIAFANI
NPFSLSSADTSEEKKLDIANQLKDKTHKIIKRIIEIEKPIETKE -continued >24 hypothetical protein [Prevotella intermedia] (SEQ ID NO: 171)
MEDDKKTTESTNMLDNKHFWAAFLNLARHNVYITVNHINKVLELKNKKDQDIIIDNDQDILAIK
THWEKVNGDLNKTERLRELMTKHFPFLETAIYTKNKEDKEEVKQEKQAEAQSLESLKDCLFLFL
EKLQEARNYYSHYKYSESTKEPMLEEGLLLEKMYNIFDDNIQLVIKDYQHNKDINPDEDFKHLDR
KGQFKYSFADNEGNITESGLLFFVSLFLEKKDAIWMQQKLTGFKDNRESKKKMTHEVFCRRRML
LPKLRLESTQTQDWILLDMLNELIRCPKSLYERLQGEYRKKFNVPFDSADEDYDAEQEPFKNTL
VRHQDRFPYFALRYFDYNEIFTNLRFQIDLGTYHFSIYKKLIGGQKEDRHLTHKLYGFERIQEF
AKQNRPDEWKALVKDLDTYETSNERYISETTPHYHLENQKIRFRNGNKEIWPSLKTNGENNE
KSKYKLDKPYQAEAFLSVHELLPMMFYYLLLKKEEPNNDKKNASIVEGFIKREIRDMYKLYDAF
ANGEINNIGDLEKYCEDKGIPKRHLPKQMVAILYDEPKDMVKEAKRKQKEMVKDTKKLLATLEK
QTQEEIEDGGRNIRLLKSGEIARWLVNDMMRFQPVQKDNEGNPLNNSKANSTEYQMLQRSLALY
NKEEKPTRYFRQVNLINSSNPHPFLKWTKWEECNNILSFYRNYLTKKIEFLNKLKPEDWEKNQY
FLKLKEPKTNRETLVQGWKNGFNLPRGIFTEPIREWFKRHQNDSKEYEKVEALKRVGLVTKVIP
LFFKEEYFKEDAQKEINNCVQPFYSFPYNVGNIHKPDEKDFLPSEERKKLWGDKKDKFKGYKAK
VKSKKLTDKEKEEYRSYLEFQSWNKFERELRLVRNQDIVTWLLCTELIDKMKVEGLNVEELQKL
RLKDIDTDTAKQEKNNILNRIMPMQLPVTVYEIDDSHNIVKDRPLHTVYIEETKTKLLKQGNFK
ALVKDRRLNGLFSFVDTSSKAELKDKPISKSVVEYELGEYQNARIETIKDMLLLEKTLIKKYEK
LPTDNFSDMLNGWLEGKDESDKARFQNDVKLLVAVRNAFSHNQYPMRNRIAFANINPFSLSSAD
ISEEKKLDIANQLKDKTHKIIKKIIEIEKPIETKE >25 hypothetical protein [Prevotella pallens] (SEQ ID NO: 172)
MKEEEKGKTPVVSTYNKDDKHFWAAFLNLARHNVYITVNHINKILGEGEINRDGYENTLEKSWN
EIKDINKKDRLSKLIIKHFPFLEVTTYQRNSADTTKQKEEKQAEAQSLESLKKSFFVFIYKLRD
LRNHYSHYKHSKSLERPKFEEDLQEKMYNIFDASIQLVKEDYKHNTDIKTEEDFKHLDRKGQFK
YSFADNEGNITESGLLFFVSLFLEKKDAIWVQKKLEGFKCSNESYQKMTNEVFCRSRMLLPKLR
LQSTQTQDWILLDMLNELIRCPKSLYERLREEDRKKFRVPIEIADEDYDAEQEPFKNALVRHQD
RFPYFALRYFDYNEIFTNLRFQIDLGTYHFSIYKKQIGDYKESHHLTHKLYGFERIQEFTKQNR
PDEWRKFVKTFNSFETSKEPYIPETTPHYHLENQKIGIRFRNDNDKIWPSLKTNSEKNEKSKYK
LDKSFQAEAFLSVHELLPMMFYYLLLKTENTDNDNEIETKKKENKNDKQEKHKIEEIIENKITE
IYALYDAFANGKINSIDKLEEYCKGKDIEIGHLPKQMIAILKSEHKDMATEAKRKQEEMLADVQ
KSLESLDNQINEEIENVERKNSSLKSGEIASWLVNDMMRFQPVQKDNEGNPLNNSKANSTEYQM
LQRSLALYNKEEKPTRYFRQVNLIESSNPHPFLNNTEWEKCNNILSFYRSYLEAKKNFLESLKP
EDWEKNQYFLMLKEPKTNCETLVQGWKNGFNLPRGIFTEPIRKWFMEHRKNITVAELKRVGLVA
KVIPLFFSEEYKDSVQPFYNYLFNVGNINKPDEKNFLNCEERRELLRKKKDEFKKMTDKEKEEN
PSYLEFQSWNKFERELRLVRNQDIVTWLLCMELFNKKKIKELNVEKIYLKNINTNTTKKEKNTE
EKNGEEKIIKEKNNILNRIMPMRLPIKVYGRENFSKNKKKKIRRNTFFTVYIEEKGTKLLKQGN
FKALERDRRLGGLFSFVKTHSKAESKSNTISKSRVEYELGEYQKARIEIIKDMLALEETLIDKY
NSLDTDNFHNMLTGWLKLKDEPDKASFQNDVDLLIAVRNAFSHNQYPMRNRIAFANINPFSLSS
ANTSEEKGLGIANQLKDKTHKTIEKIIEIEKPIETKE >26 hypothetical protein [Prevotella pleuritidis] (SEQ ID NO: 173)
MENDKRLEESACYTLNDKHFWAAFLNLARHNVYITVNHINKKTELKNKNQEIIIDNDQDILAI
KTHWAKVNGDLNKTDRLRELMIKHFPFLEAAIYSNNKEDKEEVKEEKQAKAQSFKSLKDCLFLF
LEKLQEARNYYSHYKYSESSKEPEFEEGLLLEKMYNTFDASIRLVKEDYQYNKDIDPEKDFKHLE
RKEDFNYLFTDKDNKGKITKNGLLFFVSLFLEKKDAIWMQQKFRGFKDNRGNKEKMTHEVFCRS
RMLLPKIRLESTQTQDWILLDMLNELIRCPKSLYERLQGAYREKFKVPFDSIDEDYDAEQEPFR
NTLVRHQDRFPYFALRYFDYNEIFKNLRFQIDLGTYHFSIYKKLIGGKKEDRHLTHKLYGFERI
QEFTKQNRPDKWQAIIKDLDTYETSNERYISETTPHYHLENQKIGIRFRNDNNDIWPSLKTNGE
KNEKSKYNLDKPYQAEAFLSVHELLPMMFYYLLLKMENTDNDKEDNEVGTKKKGNKNNKQEKHK
IEEIIENKIKDIYALYDAFTNGEINSIDELAEQREGKDIEIGHLPKQLIVILKNKSKDMAEKAN
RKQKEMIKDTKKRLATLDKQVKGEIEDGGRNIRLLKSGEIARWLVNDMMRFQPVQKDNEGKPLN
NSKANSTEYQMLQRSLALYNKEEKPTRYFRQVNLIKSSNPHPFLEDTKWEECYNILSFYRNYLK
AKIKFLNKLKPEDWKKNQYFLMLKEPKTNRKTLVQGWKNGFNLPRGIFTEPIKEWFKRHQNDSE
EYKKVEALDRVGLVAKVIPLFFKEEYFKEDAQKEINNCVQPFYSFPYNVGNIHKPEEKNFLHCE
ERRKLWDKKKDKFKGYKAKEKSKKMTDKEKEEHRSYLEFQSWNKFERELRLVRNQDILTWLLCT
KLIDKLKIDELNIEELQKLRLKDIDTDTAKKEKNNILNRVMPMRLPVTVYEIDKSFNIVKDKPL
HTVYIEETGTKLLKQGNFKALVKDRRLNGLFSFVKTSSEAESKSKPISKLRVEYELGAYQKARI
DIIKDMLALEKTLIDNDENLPTNKFSDMLKSWLKGKGEANKARLQNDVGLLVAVRNAFSHNQYP
MYNSEVFKGMKLLSLSSDIPEKEGLGIAKQLKDKIKETIERIIEIEKEIRN >27 hypothetical protein [Prevotella pleuritidis] (SEQ ID NO: 174)
MENDKRLEESTCYTLNDKHFWAAFLNLARHNVYITINHINKLLEIRQIDNDEKVLDIKALWQKV
DKDINQKARLRELMIKHFPFLEAAIYSNNKEDKEEVKEEKQAKAQSFKSLKDCLFLFLEKLQEA
RNYYSHYKSSESSKEPEFEEGLLEKMYNTFGVSIRLVKEDYQYNKDIDPEKDFKHLERKEDFNY
LFTDKDNKGKITKNGLLFFVSLFLEKKDAIWMQQKLRGFKDNRGNKEKMTHEVFCRSRMLLPKI
RLESTQTQDWILLDMLNELIRCPKSLYERLQGAYREKFKVPFDSIDEDYDAEQEPFRNTLVRHQ
DRFPYFALRYFDYNEIFKNLRFQIDLGTYHFSIYKKLIGDNKEDRHLTHKLYGFERIQEFAKQK
RPNEWQALVKDLDIYETSNEQYISETTPHYHLENQKIGIRFKNKKDIWPSLETNGKENEKSKY
NLDKSFQAEAFLSIHELLPMMFYDLLLKKEEPNNDEKNASIVEGFIKKEIKRMYAIYDAFANEE
INSKEGLEEYCNKGFQERHLPKQMIAILTNKSKNMAEKAKRKQKEMIKDTKKRLATLDKQVKG
EIEDGGRNIRLLKSGEIARWLVNDMMRFQSVQKDKEGKPLNNSKANSTEYQMLQRSLALYNKEQ
KPTPYFIQVNLIKSSNPHPFLEETKWEECNNILSFYRSYLEAKKNFLESLKPEDWKKNQYFLML
KEPKTNRKTLVQGWKNGFNLPRGIFTEPIKEWFKRHQNDSEEYKKVEALDRVGLVAKVIPLFFK
EEYFKEDAQKEINNCVQPFYSFPYNVGNIHKPEEKNFLHCEERRKLWDKKKDKFKGYKAKEKSK
KMTDKEKEEHRSYLEFQSWNKFERELRLVRNQDIVTWLLCTELIDKLKIDELNIEELQKLRLKD
IDTDTAKKEKNNILNRIMPMQLPVTVYEIDKSFNIVKDKPLHTIYIEETGTKLLKQGNFKALVK
DRRLNGLFSFVKTSSEAESKSKPISKLRVEYELGAYQKARIDIIKDMLALEKTLIDNDENLPTN
KFSDMLKSWLKGKGEANKARLQNDVDLLVAIRNAFSHNQYPMYNSEVFKGMKLLSLSSDIPEKE
GLGIAKQLKDKIKETIERIIEIEKEIRN -continued >28 hypothetical protein [*Prevotella saccharolytica*] (SEQ ID NO: 175)
MEKENVQGSHIYYEPTDKCFWAAFYNLARHNAYLTIAHINSFVNSKKGINNDDKVLDIIDDWSK
FDNDLLMGARLNKLILKHFPFLKAPLYQLAKRKTRKQQGKEQQDYEKKGDEDPEVIQEAIANAF
KMANVRKTLHAFLKQLEDLRNHFSHYNYNSPAKKMEVKFDDGFCNKLYYVFDAALQMVKDDNRM
NPEINMQTDFEHLVRLGRNRKIPNTFKYNFTNSDGTINNNGLLFFVSLFLEKRDAIWMQKKIKG
FKGGTENYMRMTNEVFCRNRMVIPKLRLETDYDNHQLMFDMLNELVRCPLSLYKRLKQEDQDKF
RVPIEFLDEDNEADNPYQENANSDENPTEETDPLKNTLVRHQHRFPYFVLRYFDLNEVFKQLRF
QINLGCYHFSIYDKTIGERTEKRHLTRTLFGFDRLQNFSVKLQPEHWKNMVKHLDTEESSDKPY
LSDAMPHYQIENEKIGIHFLKTDTEKKETVWPSLEVEEVSSNRNKYKSEKNLTADAFLSTHELL
PMMFYYQLLSSEEKTRAAAGDKVQGVLQSYRKKIFDIYDDFANGTINSMQKLDERLAKDNLLRG
NMPQQMLAILEHQEPDMEQKAKEKLDRLITETKKRIGKLEDQFKQKVRIGKRRADLPKVGSIAD
WLVNDMMRFQPAKRNADNTGVPDSKANSTEYRLLQEALAFYSAYKDRLEPYFRQVNLIGGTNPH
PPLHRVDWKKCNHLLSFYHDYLEAKEQYLSHLSPADWQKHQHFLLLKVRKDIQNEKKDWKKSLV
AGWKNGFNLPRGLFTESIKTWFSTDADKVQITDTKLFENRVGLIAKLIPLYYDKVYNDKPQPFY
QYPFNINDRYKPEDTRKRFTAASSKLWNEKKMLYKNAQPDSSDKIEYPQYLDFLSWKKLERELR
MLRNQDMMVWLMCKDLFAQCTVEGVEFADLKLSQLEVDVNVQDNLNVLNNVSSMILPLSVYPSD
AQGNVLRNSKPLHTVYVQENNTKLLKQGNFKSLLKDRRLNGLFSFIAAEGEDLQQHPLTKNRLE
YELSIYQTMRISVFEQTLQLEKAILTRNKTLCGNNFNNLLNSWSEHRTDKKTLQPDIDFLIAVR
NAFSHNQYPMSTNTVMQGIEKFNIQTPKLEEKDGLGIASQLAKKTKDAASRLQNIINGGTN >29 hypothetical protein [*Prevotella* sp. P5-119] (SEQ ID NO: 176)
MNIPALVENQKKYFGTYSVMAMLNAQTVLDHIQKVADIEGEQNENNENLWFHPVMSHLYNAKNG
YDKQPEKTMFIIERLQSYFPFLKIMAENQREYSNGKYKQNRVEVNSNDIFEVLKRAFGVLKMYR
DLTNHYKTYEEKLIDGCEFLTSTEQPLSGMISKYYTVALRNTKERYGYKTEDLAFIQDNIKKIT
KDAYGKRKSQVNTGFFLSLQDYNGDTQKKLHLSGVGIALLICLFLDKQYINIFLSRLPIFSSYN
AQSEERRIIIRSFGINSIKLPKDRIHSEKSNKSVAMDMLNEVKRCPDELFTTLSAEKQSRFRII
SDDHNEVLMKRSTDRFVPLLLQYIDYGKLFDHIRFHVNMGKLRYLLKADKICIDGQTRVRVIEQ
PLNGFGRLEEAETMRKQENGTFGNSGIRIRDFENVKRDDANPANYPYIVDTYTHYILENNKVEM
FISDKGSSAPLLPLIEDDRYVVKTIPSCRMSTLEIPAMAFHMFLFGSKKTEKLIVDVHNRYKRL
FQAMQKEEVTAENIASFGIAESDLPQKILDLISGNAHGKDVDAFIRLTVDDMLTDTERRIKRFK
DDRKSIRSADNKMGKRGFKQISTGKLADFLAKDIVLFQPSVNDGENKITGLNYRIMQSAIAVYD
SGDDYEAKQQFKLMFEKARLIGKGTTEPHPPLYKVFARSIPANAVDFYERYLIERKFYLTGLCN
EIKRGNRVDVPFIRRDQNKWKTPAMKTLGRIYSEDLPVELPRQMFDNEIKSHLKSLPQMEGIDF
NNANVTYLIAEYMKRVLNDDFQTFYQWKRNYHYMDMLKGEYDRKGSLQHCFTSVEEREGLWKER
ASRTERYRKLASNKIRSNRQMRNASSEEIETILDKRLSNCRNEYQKSEKVIRRYRVQDALLFLL
AKKTLTELADFDGERFKLKEIMPDAEKGILSEIMPMSFTFEKGGKKYTITSEGMKLKNYGDFFV
LASDKRIGNLLELVGSDIVSKEDIMEEFNKYDQCRPEISSIVFNLEKWAFDTYPELSARVDREE
KVDFKSILKILLNNKNINKEQSDILRKIRNAFDHNNYPDKGIVEIKALPEIAMSIKKAFGEYAI
MK Small protein sequences >30 hypothetical protein [*Psychroflexus torquis*] (SEQ ID NO: 177)
MESIIGLGLSFNPYKTADKHYFGSFLNLVENNLNAVFAEFKERISYKAKDENISSLIEKHFIDN
MSIVDYEKKISILNGYLPIIDFLDDELENNLNTRVKNFKKNFIILAEAIEKLRDYYTHFYHDPI
TFEDNKEPLLELLDEVLLKTILDVKKKYLKTDKTKEILKDSLREEMDLLVIRKTDELREKKKTN
PKIQHTDSSQIKNSIFNDAFQGLLYEDKGNNKKTQVSHRAKTRLNPKDIHKQEERDFEIPLSTS
GLVFLMSLFLSKKEIEDFKSNIKGFKGKVVKDENHNSLKYMATHRVYSILAFKGLKYRIKTDTF
SKETLMMQMIDELSKVPDCVYQNLSETKQKDFIEDWNEYFKDNEENTENLENSRVVHPVIRKRY
EDKFNYFAIRFLDEFANFKILKFQVFMGYYIHDQRTKTIGTTNITTERTVKEKINVFGKLSKMD
NLKKHFFSQLSDDENTDWEFFPNPSYNFLTQADNSPANNIPIYLELKNQQIIKEKDAIKAEVNQ
TQNRPNPNKPSKRDLLNKILKTYEDFHQGDPTAILSLNEIPALLHLFLVKPNNKTGQQIENIIRI
KIEKQFKAINHPSKNNKGIPKSLFADINVRVNAIKLKKDLEAELDMLNKKHIAFKENQKASSNY
DKLLKEHQFTPKNKRPELRKYVFYKSEKGEEATWLANDIKRFMPKDFKTKWKGCQHSELQRKLA
FYDRHTKQDIKELLSGCEFDHSLLDINAYFQKDNFEDFFSKYLENRIETLEGVLKKLHDFKNEP
TPLKGVFKNCFKFLKRQNYVTESPEIIKKRILAKFTFLPRGVFDERPTMKKGKNPLKDKNEFAE
WFVEYLENKDYQKFYNAEEYRMRDADFKKNAVIKKQLKLDFYTLQMVNYLLKEVFGKDEMNLQL
SELFQTRQERLKLQGIAKKQMNKETGDSSENTRNQTYIWNKDVPVSFFNGKVTIDKVKLKNIGK
YKRYERDERVKTFIGYEVDEKWMMYLPHNWKDRYSVKPINVIDLQIQEYEEIRSHELLKEIQNL
EQYIYDHTTDKNILLQDGNPNFKMYVLNGLLIGIKQVNIPDFIVLKQNTNFDKIDFTGIASCSE
LEKKTIILIAIRNKFAHNQLPNKMIYDLANEFLKIEKNETYANYYLKVLKKMISDLA >1 hypothetical protein [*Bergeyella zoohelcum*] (SEQ ID NO: 178)
MIELINFSAEYVFGKAPLITAGNLSDGLLFFAIALFIGCLIHIITFWLIKRKWYKKLACTPMDK
MKNDEYITEILPDLKEIYRTNKGISVTENISNGSVFDTAYYYLEAQGKISQAKNFQSIYFLFRN
IVTLSLFVLPVSVIFLLASFFMNDCSLSEKIITIIIGTFVLGGLSSVIAQWFRVKMTDRIFGLY
YAELTHNKK >2 MULTISPECIES: hypothetical protein [*Prevotella*] (SEQ ID NO: 179)
MIIALITSLFSSATIIFAGYRTYRNAIKKLREESIENIKRAHYEAILKAHQSIYKLLRFTTDTE
NDDCILVWEQPKDGGEKTYYFRQANIRQFFKELTEEVYNKGNGIYLSKEVMSLIFKYRTLVHKL
LLAEKNNPDEKIMIHNREVVKEMIEINQSLSIQIRKDIDLQQRNLYNHNKKGKKYWWKRKKQNI >3 hypothetical protein [*Prevotella buccae*] (SEQ ID NO: 180)
MDYMELAKEAFSIICTFIAAYVAYYYAIKQLHQKSVENIEYAKYQAVLQAHKSLYKLLRFTTNT
ENEDSILIWEKTKDGKQEATYYFRKENIRKFIKELSKEIYNEGCGIPMSKEALSLISEYRNIVY
GFMLSAQNNPQETIRITNRESVERMKKIHQNLSIEIRQAINLKKRDLRF >4 hypothetical protein [*Porphyromonas gingivalis*] (SEQ ID NO: 181)
MEKFSLYDFLAIILPGIAFIVVFRIIFSSLHLSLPVDIPLGESTIVYALICGAVLYVLSFSLV
KLFPRLFGLYRHVADLYQKMKALHPIMNDTLNRQAEQWGLGKIYLSEEEFCQSEEKEKIRMLQS -continued
DFYDRMWYRLDFRGKLGNAKSFQCYYFFFRHSFWGLVLISLILLSYKLLAYIPACDMEDIGWRE
YSDIAVPIMILSALFVFLAQWFRIKMVEKMYWTFYISLIEQENSNL >5 hypothetical protein [*Bacteroides pyogenes*] (SEQ ID NO: 182)
MNKFSLYDFLSILLPGVIFLVAIRVAQPFWRFNTGLYFPQGWEFSLVYSLVIGASLYVLGFSVK
KNYSVFFRRLGLYEHVTILYHRFETLHPFMNGALNKYAEEWNGTKPYCTVEQYDAMDASAQKEI
EDAQDIFYDHMYYRLDCKGKLEGAKAFQSYYLCFLHSFLGLLIFGVYLLICILLSYFMDVLLAD
TWQVAFLFLMNLCVMYLFMRLARWFRQRMVLKMYWAFYESLIE >8 hypothetical protein [*Riemerella anatipestifer*] (SEQ ID NO: 183)
MYWILEVLKIVTPTIAVIVSAIVSTIVLSRKIRQELKGNIERQKYEDILHAHKQMYRLLAYMTD
QDNPKNLLKWEVPKGQKDKIHYINRANAQAFLRELPELFYGEGCGLFLSEEVTKKFFEYRSIVH
KLLLAEQNSTEAEFRLKNEEAATRMKVLHHKLSQSIRQCLKIEQRDLKAL >9 hypothetical protein [*Prevotella aurantiaca*] (SEQ ID NO: 184)
MDCTLISKEVATALLSTISSFIPIVIAAYLTYRYAIKKLHKESIENIERAKYEAILKAHQSIYK
LLRFTTDTENDDCILLWEQSKGSKEKVYYFRQANIRKFIKELTEEIYNKGNGIYLSKEVILLVF
KYRTLVHKLLLAEKNNPDEKIMISKQEIAKSMIEIHQSLSIQIRNDINLKKRDLCLNSENT >11 hypothetical protein [*Myroides odoratimimus*] (SEQ ID NO: 185)
MDKLSLYELFSFVIPGGIALHLLNWCSVNVLSTGTLFNLSDLSNSLIALVFALLIGVTLHIITF
NILLKCGSYRQIIYKSVQEIKLDDYIQQVIPFLNQEYFHNKKHEVAANTNNAVPAENLFDYAYY
YLEVNGKNAQAKNFQSLYFFFRNMFTLGIVSIVILIIALVYSTITSVGKDVLSEIVFKIAFFAV
IIGIAVPVANWLRKKMIITVFGCYYADRVHQTNK >13 hypothetical protein [*Bacteroides pyogenes*] (SEQ ID NO: 186)
MNKFSFYDFLSILLPGVIFLVAIRVAQLFWRFNTGLYFPQGWEFSLVYSLVIGASLYVLGFSVK
KNYSGFFRCLGLYEHVTILYYRFETLHPFMNGALNKYAEEWNGTKPYCTVEQYDAMDASAQKEI
EDAQDIFYDHMYYRLDCKGKLEGAKAFQSYYLCFLHSFLGLLIFGVYLLICILLSYPMDVLLAD
TWQVAFLFLMNLCVMYLFMRLARWFRQRMVLKMYWAFYESLIE >14 hypothetical protein [*Capnocytophaga canimorsus*] (SEQ ID NO: 187)
MDRLSIYELLSFVVPGVIMIELINFSAEYVFGKDRLITAGNLSDGLLFFAIALFIGCLIHIITF
RLIKRKWYKKLAYKPINEIENNAYIKQIFTTLKEEYSKIHNINSIDEISKLNIFEAVITT >15 hypothetical protein [*Capnocytophaga cynodegmi*] (SEQ ID NO: 188)
MERLSIYELLSFVVLGVIMIELMNFSAEYVFGKAPLITAGNLSDSLLFFAIALFIGCLIHIITF
RLIKRKWYQKLACTPMDKMKNDEYITEILPHLKEIYRANKGISATENISNGSVFDTAYYYLEAQ
GKISQAKNFQSIYFLFRNIVTLSLFVLPVSVIFLLASFFMNDCKLSGKIITIVIGTLVIGGISS
VIAQWFRVKMTDRIFGLYYAELTHHKK >17 hypothetical protein [*Phaeodactylibacter xiamenensis*]
(SEQ ID NO: 189)
MDEGTLLINILTGPAKDKPLWFEFIGIGVTISLAAWGYLRAFGAWEKQKKRELELQHKQRKLEI
KLQFEKQRYEHELKAAEGVWPLLAYFSLWENDKSVFVKRGDHWYFRQEQGREYILALSENFFNK
GYGVPMPGPAKENLYHFRGMIYKLLQDSKSNGNDNNEVLLKNQSMVQKKDKQAAPNKKSVEQLK
DEINASLRNMLQKSEIDLD >18 hypothetical protein [*Porphyromonas gingivalis*] (SEQ ID NO: 190)
MMTMTICWTPICVQLIKLSGIFIAAYLAYRYAVHKLSKESIENIERCKYQAVLEAHRSFYKLLR
FTTDTENADSILVWQKAKGGGAKTYYFRPACIRGFLSELTDEFYKNGNGIFLSKEIISRIFEYR
SIVYGLLLSERQNSDERVVMNKPETAERMISIHQELTQTVREAIALKKRTLNF >19 hypothetical protein [*Porphyromonas gulae*] (SEQ ID NO: 191)
MEKFSLYDFLAIILPGIAFIVVFRVVFSSLHLSLPVDIPLDLEFTIVYALICGAVLYVLSFSLV
KLFPRLFGLYRHVADLYQRMKALHPIMNDTLNRQAEQWGLGRIYLSEEEYCRSEEKEKIRMLQS
DFYNRMWYRLDFRGKLGNAKSFQCYYFFFRHSFLGLVLISLILLSYKLLAYIPACELEDIGWKE
YSDIAVPIIILSVLFVFLAQWFRIKMVEKMYWTFYISLIEQENSNL >20 hypothetical protein [*Porphyromonas gulae*] (SEQ ID NO: 192)
MMTMTICWTPICVQLIKLSGIFIAAYLAYRYAVRKLSKESIENIERCKYQAVLEAHRSFYKLLR
FTTDTENADSILVWQKAKGGGAKTYYFRPACIRGFLSELTDEFYKNGNGVFLSKEIISRIFEYR
SIVYGLLLSERQNSDERIVMNKPETAERMIRIHQELTQTVREAIALKGRTLNF >21 hypothetical protein [*Porphyromonas gulae*] (SEQ ID NO: 193)
MTMTICWTPICVQLIELSGIFIAAYLAYRYAVRKLSKESIENIERCKYQAVLEAHRSFYKLLRF
TTDTENADSILVWQKAKGGGAKTYYFRPACIRGFLSELTDEFYKNGNGVFLSKEIISRIFEYRS
IVYGLLLSERDSSDERIVMNKPETAERMIRIHQELTQTVREAIALKGRTLNF >22 hypothetical protein [*Prevotella falsenii*] (SEQ ID NO: 194)
MIIALIPALINSAAIIVVYLTYFYAVKKLREESFENIERAKYEAILKAHQSVYKLLRFITDTE
NDDCILVWEEPKGGGEKAYYFRQANIRKFIRELTEEIYNKGNGIFLSKKTMSLIFEYRTLVYGL
LLTAKDNPAEAIEITNKKLAKRMIEIHQSLSIQIRKDRNLQQ >23 hypothetical protein [*Prevotella intermedia*] (SEQ ID NO: 195)
MDCTLISKEVATALFSTISSLIPIVIAAYLTYRYAIKKLRKESFENIERAKYEAILKAHQSIYK
LLRFITDTENDDCILVWEQPKGGGEKTYYFRQANIRKFIKELTEEIYNKGNGIFLSKKVMPLIF
EYRSLVYGLLLTAKDKPDETIEIKNEKLAKRMIEIHQSLSIQIRKDINLKQRDLQLDNKKGKKW
CWKRKKQNI

```
>24 hypothetical protein [Prevotella intermedia] (SEQ ID NO: 196)
MDCTLISKEVATAMFSTISSLIPIVIAAYLTYRYAIKKLRKESFENIERAKYEAVLKAHQSIYK
LLRFITDTENDDCIMVWEQPKGGGEKVYYFRQANIRKFIKELTEEIYNKGNGIFLSKKVMPLIF
EYRSLVYGLLLTAKDKPDETIEIKNEKLAKRMIEIHQSLSIQIRKDINLKQRDLQFDS >26 hypothetical protein [Prevotella pleuritidis] (SEQ ID NO: 197)
MDCTLISKEVATALFSTLSSLVPIVIAAYLTYRYAIKKLHKESFESIECAKYEAILKAHQSIYK
LLRFITDTENDDCILVWEQPKGGGENVYYFRQANIRKFIKELTEEIYNKGNGIFLSKEVMSLIF
EYRSLVYGLLLTEKDNPKDKIIIKNLKLAKRMIEIHQNLSIKIREAINLQQRDLHFK >27 hypothetical protein [Prevotella pleuritidis] (SEQ ID NO: 198)
MDCTLISKEVATALFSTLSSLVPIVIAAYLTYRYAIKKLHKESFESIECAKYEAILKAHQSIYK
LLRFITDTENDDCILVWEQPKGGGEKTYYFRQANIRKFIKELTEEIYNKGNGIYLSKEVMSLIF
KYRTLVHKLLLAKKNNPDEKIMIDKRELAKRMIEIHQNLSIKIREAINLQQRDLHFK >28 hypothetical protein [Prevotella saccharolytica] (SEQ ID NO: 199)
MECNDCSQLITTLVSLLTAALSGFLSYYFAVRKYRKESQENVERWKYEAIWHAHQSFYKLLRFM
TDNENADSILVFRKQEGSKQPQPIFRKDKAREFLAELTDEFYKKGNGLFLSKEVADSLFKYRHI
VFGLLQVFSNYDENEVQLKNTQAVENMKKNFQQLSPEIRKSLHLHRRDLLFS
```

1. Abil Z, Zhao H. Engineering reprogrammable RNA-binding proteins for study and manipulation of the transcriptome. Molecular bioSystems. 2015; 11(10):2658-65. doi: 10.1039/c5mb00289c. PubMed PMID: 26166256.
2. Abudayyeh 00, Gootenberg J S, Konermann S, Joung J, Slaymaker I M, Cox D B, et al. C2c2 is a single-component programmable RNA-guided RNA-targeting CRISPR effector. Science. 2016; 353(6299):aaf5573. doi: 10.1126/science.aaf5573. PubMed PMID: 27256883.
3. Anantharaman V, Makarova K S, Burroughs A M, Koonin E V, Aravind L. Comprehensive analysis of the HEPN superfamily: identification of novel roles in intra-genomic conflicts, defense, pathogenesis and RNA processing. Biology direct. 2013; 8:15. doi: 10.1186/1745-6150-8-15. PubMed PMID: 23768067; PubMed Central PMCID: PMC3710099.
4. Bernhart S H, Hofacker I L, Stadler P F. Local RNA base pairing probabilities in large sequences. Bioinformatics. 2006; 22(5):614-5. doi: 10.1093/bioinformatics/btk014. PubMed PMID: 16368769.
5. Biswas A, Gagnon J N, Brouns S J, Fineran P C, Brown C M. CRISPRTarget: bioinformatic prediction and analysis of crRNA targets. RNA biology. 2013; 10(5):817-27. doi: 10.4161/rna.24046. PubMed PMID: 23492433; PubMed Central PMCID: PMC3737339.
6. Brouns S J, Jore M M, Lundgren M, Westra E R, Slijkhuis R J, Snijders A P, et al. Small CRISPR RNAs guide antiviral defense in prokaryotes. Science. 2008; 321 (5891):960-4. doi: 10.1126/science.1159689. PubMed PMID: 18703739.
7. Camacho C, Coulouris G, Avagyan V, Ma N, Papadopoulos J, Bealer K, et al. BLAST+: architecture and applications. BMC bioinformatics. 2009; 10:421. doi: 10.1186/1471-2105-10-421. PubMed PMID: 20003500; PubMed Central PMCID: PMC2803857.
8. Crooks G E, Hon G, Chandonia J M, Brenner S E. WebLogo: a sequence logo generator. Genome research. 2004; 14(6):1188-90. doi: 10.1101/gr.849004. PubMed PMID: 15173120; PubMed Central PMCID: PMC419797.
9. East-Seletsky A, O'Connell M R, Knight S C, Burstein D, Cate J H, Tjian R, et al. Two distinct RNase activities of CRISPR-C2c2 enable guide-RNA processing and RNA detection. Nature. 2016. doi: 10.1038/nature19802. PubMed PMID: 27669025.
10. Edgar R C. PILER-CR: fast and accurate identification of CRISPR repeats. BMC bioinformatics. 2007; 8:18. doi: 10.1186/1471-2105-8-18. PubMed PMID: 17239253; PubMed Central PMCID: PMC1790904.
11. Filipovska A, Rackham 0. Designer RNA-binding proteins: New tools for manipulating the transcriptome. RNA biology. 2011; 8(6):978-83. doi: 10.4161/rna.8.6.17907. PubMed PMID: 21941129.
12. Gerdes S Y, Scholle M D, Campbell J W, Balazsi G, Ravasz E, Daugherty M D, et al. Experimental determination and system level analysis of essential genes in Escherichia coli MG1655. Journal of bacteriology. 2003; 185(19):5673-84. PubMed PMID: 13129938; PubMed Central PMCID: PMC193955.
13. Hale C R, Cocozaki A, Li H, Terns R M, Terns M P. Target RNA capture and cleavage by the Cmr type III-B CRISPR-Cas effector complex. Genes & development. 2014; 28(21):2432-43. doi: 10.1101/gad.250712.114. PubMed PMID: 25367038; PubMed Central PMCID: PMC4215187.
14. Hale C R, Majumdar S, Elmore J, Pfister N, Compton M, Olson S, et al. Essential features and rational design of CRISPR RNAs that function with the Cas RAMP module complex to cleave RNAs. Molecular cell. 2012; 45(3): 292-302. doi: 10.1016/j.molcel.2011.10.023. PubMed PMID: 22227116; PubMed Central PMCID: PMC3278580.
15. Hale C R, Zhao P, Olson S, Duff M O, Graveley B R, Wells L, et al. RNA-guided RNA cleavage by a CRISPR RNA-Cas protein complex. Cell. 2009; 139(5):945-56. doi: 10.1016/j.cell.2009.07.040. PubMed PMID: 19945378; PubMed Central PMCID: PMC2951265.
16. Hayes F, Van Melderen L. Toxins-antitoxins: diversity, evolution and function. Critical reviews in biochemistry and molecular biology. 2011; 46(5):386-408. doi: 10.3109/10409238.2011.600437. PubMed PMID: 21819231.
17. Jiang W, Samai P, Marraffini L A. Degradation of Phage Transcripts by CRISPR-Associated RNases Enables Type III CRISPR-Cas Immunity. Cell. 2016; 164(4):710-21. doi: 10.1016/j.cell.2015.12.053. PubMed PMID: 26853474; PubMed Central PMCID: PMC4752873.
18. Jinek M, Chylinski K, Fonfara I, Hauer M, Doudna J A, Charpentier E. A programmable dual-RNA-guided DNA endonuclease in adaptive bacterial immunity. Science. 2012; 337(6096):816-21. doi: 10.1126/science.1225829. PubMed PMID: 22745249.
19. Mackay J P, Font J, Segal D J. The prospects for designer single-stranded RNA-binding proteins. Nature structural & molecular biology. 2011; 18(3):256-61. doi: 10.1038/nsmb.2005. PubMed PMID: 21358629.
20. Makarova K S, Anantharaman V, Aravind L, Koonin E V. Live virus-free or die: coupling of antivirus immunity and programmed suicide or dormancy in prokaryotes. Biology direct. 2012; 7:40. doi: 10.1186/1745-6150-7-40. PubMed PMID: 23151069; PubMed Central PMCID: PMC3506569.
21. Makarova K S, Haft D H, Barrangou R, Brouns S J, Charpentier E, Horvath P, et al. Evolution and classification of the CRISPR-Cas systems. Nature reviews Microbiology. 2011; 9(6):467-77. doi: 10.1038/nrmicro2577. PubMed PMID: 21552286; PubMed Central PMCID: PMC3380444.
22. Makarova K S, Wolf Y I, Alkhnbashi O S, Costa F, Shah S A, Saunders S J, et al. An updated evolutionary classification of CRISPR-Cas systems. Nature reviews Microbiology. 2015; 13(11):722-36. doi: 10.1038/nrmicro3569. PubMed PMID: 26411297.
23. Makarova K S, Wolf Y I, Koonin E V. Comprehensive comparative-genomic analysis of type 2 toxin-antitoxin systems and related mobile stress response systems in prokaryotes. Biology direct. 2009; 4:19. doi: 10.1186/1745-6150-4-19. PubMed PMID: 19493340; PubMed Central PMCID: PMC2701414.
24. Marraffini L A. CRISPR-Cas immunity in prokaryotes. Nature. 2015; 526(7571):55-61. doi: 10.1038/nature15386. PubMed PMID: 26432244.
25. Moller S, Croning M D, Apweiler R. Evaluation of methods for the prediction of membrane spanning regions. Bioinformatics. 2001; 17(7):646-53. PubMed PMID: 11448883.
26. Nunez J K, Lee A S, Engelman A, Doudna J A. Integrase-mediated spacer acquisition during CRISPR-Cas adaptive immunity. Nature. 2015; 519(7542):193-8. doi: 10.1038/nature14237. PubMed PMID: 25707795; PubMed Central PMCID: PMC4359072.
27. Remmert M, Biegert A, Hauser A, Soding J. HHblits: lightning-fast iterative protein sequence searching by HMM-HMM alignment. Nature methods. 2012; 9(2):173-5. doi: 10.1038/nmeth.1818. PubMed PMID: 22198341.
28. Shmakov S, Abudayyeh O O, Makarova K S, Wolf Y I, Gootenberg J S, Semenova E, et al. Discovery and Functional Characterization of Diverse Class 2 CRISPR-Cas Systems. Molecular cell. 2015; 60(3):385-97. doi: 10.1016/j.molcel.2015.10.008. PubMed PMID: 26593719; PubMed Central PMCID: PMC4660269.
29. Staals R H, Agari Y, Maki-Yonekura S, Zhu Y, Taylor D W, van Duijn E, et al. Structure and activity of the RNA-targeting Type III-B CRISPR-Cas complex of *Thermus thermophilus*. Molecular cell. 2013; 52(1):135-45. doi: 10.1016/j.molcel.2013.09.013. PubMed PMID: 24119403; PubMed Central PMCID: PMC4006948.
30. Staals R H, Zhu Y, Taylor D W, Kornfeld J E, Sharma K, Barendregt A, et al. RNA targeting by the type III-A CRISPR-Cas Csm complex of *Thermus thermophilus*. Molecular cell. 2014; 56(4):518-30. doi: 10.1016/j.molcel.2014.10.005. PubMed PMID: 25457165; PubMed Central PMCID: PMC4342149.
31. Tafer H, Ameres S L, Obernosterer G, Gebeshuber C A, Schroeder R, Martinez J, et al. The impact of target site accessibility on the design of effective siRNAs. Nature biotechnology. 2008; 26(5):578-83. doi: 10.1038/nbt1404. PubMed PMID: 18438400.
32. Tamulaitis G, Kazlauskiene M, Manakova E, Venclovas C, Nwokeoji A O, Dickman M J, et al. Programmable RNA shredding by the type III-A CRISPR-Cas system of *Streptococcus thermophilus*. Molecular cell. 2014; 56(4): 506-17. doi: 10.1016/j.molcel.2014.09.027. PubMed PMID: 25458845.
33. van der Oost J, Jore M M, Westra E R, Lundgren M, Brouns S J. CRISPR-based adaptive and heritable immunity in prokaryotes. Trends in biochemical sciences. 2009; 34(8):401-7. doi: 10.1016/j.tibs.2009.05.002. PubMed PMID: 19646880.
34. Wright A V, Nunez J K, Doudna J A. Biology and Applications of CRISPR Systems: Harnessing Nature's Toolbox for Genome Engineering. Cell. 2016; 164(1-2): 29-44. doi: 10.1016/j.cell.2015.12.035. PubMed PMID: 26771484.
35. Yates A, Akanni W, Amode M R, Barrell D, Billis K, Carvalho-Silva D, et al. Ensembl 2016. Nucleic acids research. 2016; 44(D1):D710-6. doi: 10.1093/nar/gkv1157. PubMed PMID: 26687719; PubMed Central PMCID: PMC4702834.
36. Yosef I, Goren M G, Qimron U. Proteins and DNA elements essential for the CRISPR adaptation process in *Escherichia coli*. Nucleic acids research. 2012; 40(12): 5569-76. doi: 10.1093/nar/gks216. PubMed PMID: 22402487; PubMed Central PMCID: PMC3384332.
37. Zhang J, Rouillon C, Kerou M, Reeks J, Brugger K, Graham S, et al. Structure and mechanism of the CMR complex for CRISPR-mediated antiviral immunity. Molecular cell. 2012; 45(3):303-13. doi: 10.1016/j.molcel.2011.12.013. PubMed PMID: 22227115; PubMed Central PMCID: PMC3381847.

Example 2: Validation of Group 29 Effector Protein RNA Interference in Bacteria, In Vitro (Biochemically) and in Eukaryotic (Human) Cells Mammalian Interference Assays (Protein and crRNA Plasmids): For mammalian interference experiments, Applicants designed two plasmids to co-transfect in HEK 293T cells:
  Protein plasmid containing CMV-driven Group 29 proteins human codon optimized for 11 species (proteins 1-11 from select unique proteins).
  crRNA plasmid containing U6-driven crRNA with repeat and target sequences, repeats varying by species and targets dependent on assay.

Exogenous Luciferase-Based Assay: Applicants conducted the exogenous mammalian interference assay in HEK 293T cells using Promega's Nano-Glo® Dual-Luciferase® Reporter Assay. Luciferase assays offer the highest sensitivity in optical readout of gene transcript activity, and the recently engineered NLuc offers >2 orders of magnitude sensitivity than Fltuc and Rluc. Nluc and Fluc for normalization will be expressed on two lentiviral backbone plasmids driven by CMV or another constitutive mammalian promoter (or perhaps an inducible pronoter). The plasmids will have antibiotic resistance genes for possible transaction into Nluc/Fluc expressing HEK 293T cell lines. In addition, canonical U22 introns may be included in active NIuC and Rluc regions to allow for crRNA target sequences that span exons across the intron.

Endogenous Transcript RT-qPCR Assay: Applicants conducted the endogenous mammalian interference assay in HEK 293T cells using crRNA target sequences that span exons across introns in endogenous mammalian genes, for example, CXCR4 and B4GALNT1. Applicants assessed RNA interference through RT-qPCR, from which delta CT values will be used to calculate relative interference across samples and conditions.

MS2 Phage Interference: To assay potential RNA targeting capabilities of group 29 CRISPR nucleases Applicants designed a series of constructs that may interfere with replication of the MS2 phage. The MS2 phage is a +single-stranded RNA virus that infects *E. coli* as further described in Kannoly, S., Shao, Y. & Wang, I.N. Rethinking the evolution of single-stranded RNA (ssRNA) bacteriophages based on genomic sequences and characterizations of two R-plasmid-dependent ssRNA phages, C-1 and Hgall. *Journal of bacteriology* 194, 5073-5079 (2012). Its replication does not involve any DNA intermediates. CRISPR systems that specifically act on RNA can be utilized to interfere with MS2 replication_ENREF_2 as further described in Tamulaitis, G., et al. Programmable RNA shredding by the type III-A CRISPR-Cas system of *Streptococcus thermophilus*. *Molecular cell* 56, 506-517 (2014). To test whether group 29 proteins can cleave RNA, Applicants designed a series of constructs that may direct group 29 nucleases to interfere with MS2 replication. The assay specifically involves 1) creating *E. coli* carrying group 29 loci on the chloramphenicol resistant plasmid pACYC184, whose elements are expressed under their natural or synthetic promoters and contain crRNA expression cassettes targeting the mat, lys and rep MS2 genes, 2) infecting the *E. coli* from step1 above with the MS2 phage and 3) determining infection efficiency by standard efficiency of plaquing assays.

Plasmid Interference Assays: To assay potential RNA targeting capabilities of Group 29 CRISPR nucleases Applicants designed a series of constructs that interfere with gene expression from the pUC19 plasmid. The assay specifically involves 1) creating chemically competent E. co/i carrying group 29 loci on the chloramphenicol resistant plasmid pACYC184, whose elements are expressed under their natural or synthetic promoters and contain crRNA expression cassettes targeting the ampicillin resistance gene of pUC19, 2) transforming the *E. coli* from step 1 above with the pUC19 plasmid and 3) enumerating the colonies that are resistant to both chloramphenicol and ampicillin through plating on LB agar plates with appropriate antibiotics.

If Group 29 loci with properly targeted crRNAs display a reduction in the number of chloramphenicol, ampicillin resistant cfu relative to controls, then interference has likely occurred. Furthermore, by designing crRNAs predicted to hybridize to the ampicillin resistance transcript (bla) or non-transcribed parts of pUC19 Applicants expect to assay whether interference is the result of mRNA targeting or DNA cleavage. If Group 29 targets mRNA for destruction, then only crRNAs complementary to the transcript should abrogate ampicillin resistance. If Group 29 targets DNA for destruction, then only crRNAs targeting sequences with the correct PAM (if a PAM is required for cleavage) would be expected to result in a loss of ampicillin resistance for transformed cells.

Protein Purification: Applicants expressed and purified the Group 29 proteins using standard assays as further described in Rigaut, Guillaume, et al. "A generic protein purification method for protein complex characterization and proteome exploration." Nature biotechnology17.10 (1999): 1030-1032. In brief, Applicants cloned the Group 29 large proteins (as described in the present application) into the pET21 expression vector and fused it to a 6× His tag for Ni-His purification and to Maltose binding protein to aid in solubility. The Group 29 proteins will be expressed in *Escherichia coli* Rosetta 2 (DE3) (Novagen) and purified using Ni-NTA resin (Bio-Rad) using gravity flow columns. Proteins are further purified using size exclusion chromatography.

Electrophoretic Mobility Shift Assay (EMSA) and Cleavage Assay: Applicants performed an EMSA and a cleavage assay as described by Tamulaitis, Gintautas et al. "Programmable RNA Shredding by the Type III-A CRISPR-Cas System of *Streptococcus thermophilus*." Molecular Cell 56, 506-517, 2014 with some minor modifications. For EMSA, Applicants incubated purified Group 29 proteins with fluorescently labeled nucleic acids (including crRNAs and dual repeat crRNAs) and ran them on a native PAGE gel. For the cleavage assay, Applicants incubated Group 29 proteins with crRNAs and the target nucleic acid at 25° C. and 370 C and ran the target nucleic acid on a PAGE gel to analyze cleavage.

RNA Purification for In Vitro Assays: To purify enough RNA for the Group 29 in vitro RNA binding/cleavage assays, Applicants followed a protocol from Rapid purification of RNAs using fast performance liquid chromatography (FPLC) (Kim et al., RNA, 2007). This one-day protocol involves in vitro transcription with T7 polymerase, followed by fast performance liquid chromatography (FPLC) size-exclusion chromatography. Applicants synthesized and purified Group 29 crRNAs (repeats with target sequences) and target RNA. For target RNA, Applicants synthesized both ssRNA complimentary to target sequence and dsRNA with target sequence (complimentary ssRNA annealed to its reverse compliment).

Protocol for FIG. 35: In vitro cleavage assay. Testing cleavage timecourse with 1:1:1 Target:crRNA:Prot molar ratio of a single target, single guide (EGFP1 target) T2 crRNA and 01 (N2) crRNA.

Protein concentration variation IVC Protocol
1. Normalize short crRNA to 36.5 ng/uL
2. Normalize each PAM library to 100 ng/uL
3. Make 10× buffer+DTT
4. Dilute protein in H2O: Need 26 samples=7 uL protein+ 19 uL H2O
5. Make Master Mix EGFP Target 1-MM

| RNAse Inhibitor | 1 uL | 36 uL |
|---|---|---|
| 10x Buffer w/DTT | 1 uL | 36 uL |
| ddH2O | 5 uL × 36 | 180 uL |
| E1 (100 ng/uL) | 1 uL | 36 uL |
| Total | 8 uL | |

Layout:

| Lane | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| Time | 0 min | 1 min | 5 min | 10 min | 20 min | 30 min | 60 min | 90 min | 0 min | 0 min | 0 min | 90 min | 90 min | 90 min |
| crRNA | + | + | + | + | + | + | + | + | + | − | − | + | − | − |
| protein | + | + | + | + | + | + | + | + | − | + | − | − | + | − |

1. MM for time samples for each crRNA (9× for 8 samples). Take 72 uL of MM, add 9 uL of diluted protein and 9 uL. Add 10 uL per well.
2. MM for ~protein+crRNA. For each crRNA, pipette 17.6 uL MM, 2.2 uL of diluted salt, 2.2 of crRNA. Pipette 10 uL to 90 min timepoint.
3. MM for ~crRNA (make for all 4 samples). Pipette 35.2 MM, 4.4 H2O, 4.4 protein dil.
4. MM for ~prot-crRNA (make for all 4 samples). Pipette 35.2 MM, 4.4 H2O, 4.4 dil salt.
5. Mix components. Incubate at times indicated above.
6. For each time point, at the proper time, heat for 5 min at 85° C., then add 1 uL of Proteinase K at RT (15 min).
7. Set up gel(s). Heat at 42° C. When 15 min left on incubation, start running gel (to stabilize internal temperature).
8. Remove 5 uL of mix, add 5 uL of 2× loading dye.
9. Freeze down rest for sequencing.
10. Heat 10 uL at 95° C. for 5 minutes.
11. Chill on ice and spin down.
12. Load 8 uL per lane. Load tightly.
13. Run gel at 180V for 45 minutes at 42° C.
14. Take out gels and wash into DI water.
15. Image downstairs no later than 1 hr after finishing gel.

Figure 35A:
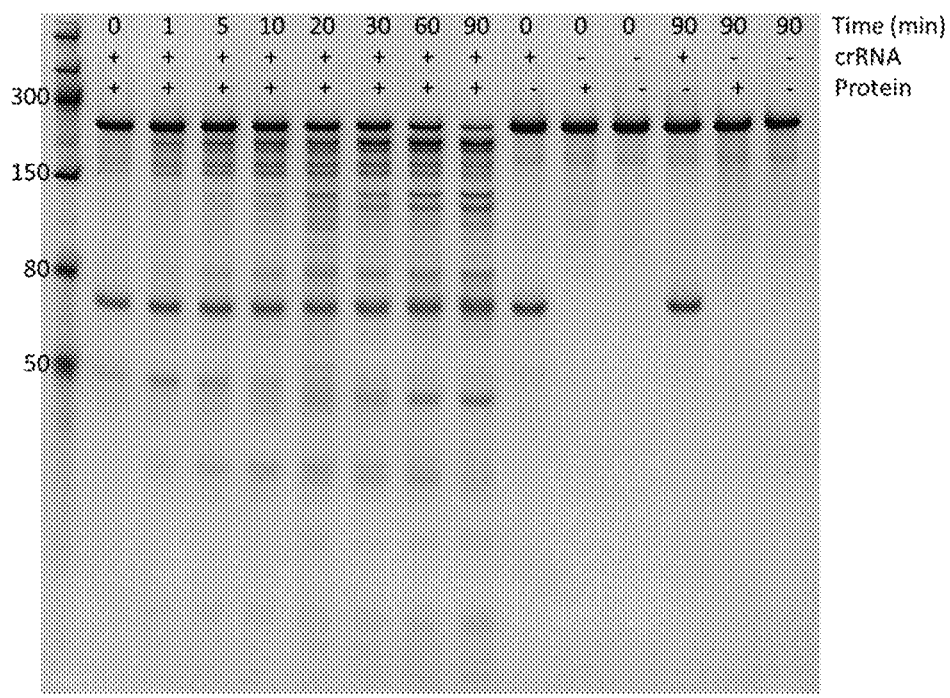
FIGS. 35A and 35B show results of cleavage assay of an EGFP RNA target by Group 29 effector (from *Bergeyella zoohelcum* ATCC 43767) over the indicated time points.
Figure 35B:
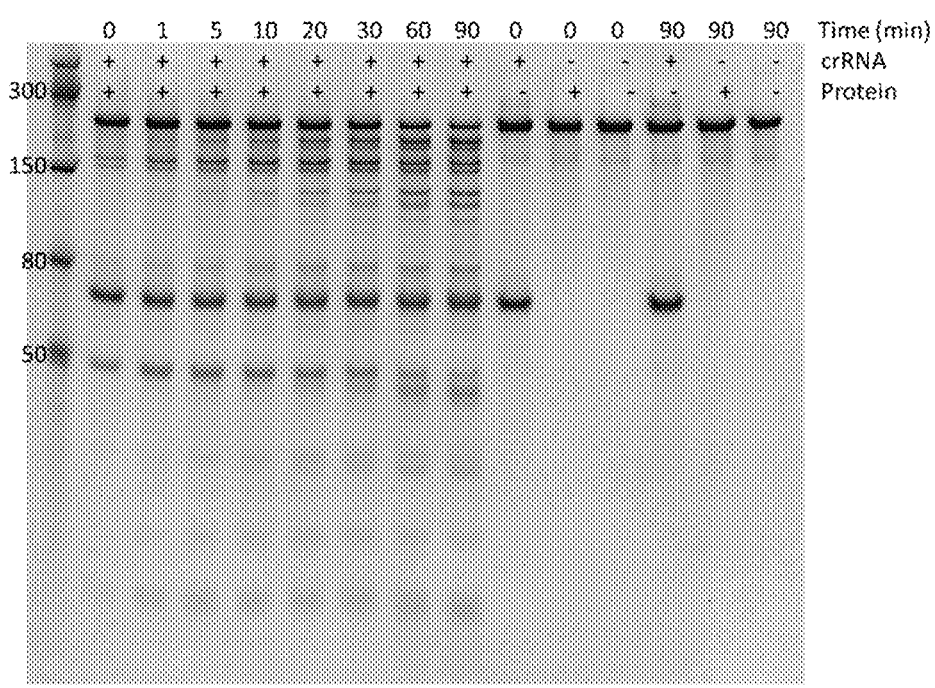

FIG. 35 shows the results of an in vitro cleavage assay of EGFP RNA by Group 29 proteins (purified from *Bergeyella zoohelcum* ATCC 43767). Two different crRNAs were used (FIG. 35A and FIG. 35B respectively). Cleavage reactions were performed for the indicated time points in the presence or absence of crRNA and/or effector protein in a buffer containing 50 mM NaCl, 1 mM DTT, Tris-HCl pH7.5, 0.1% BSA. Components were mixed at 1:1:1 target:protein:crRNA ratio. From FIG. 35 it seems that Group 29 protein makes one or a few initial cuts, and as time goes by, the target is further processed. Cutting appears to be non-random, as cut patterns are reproducible.

Figure 36A:
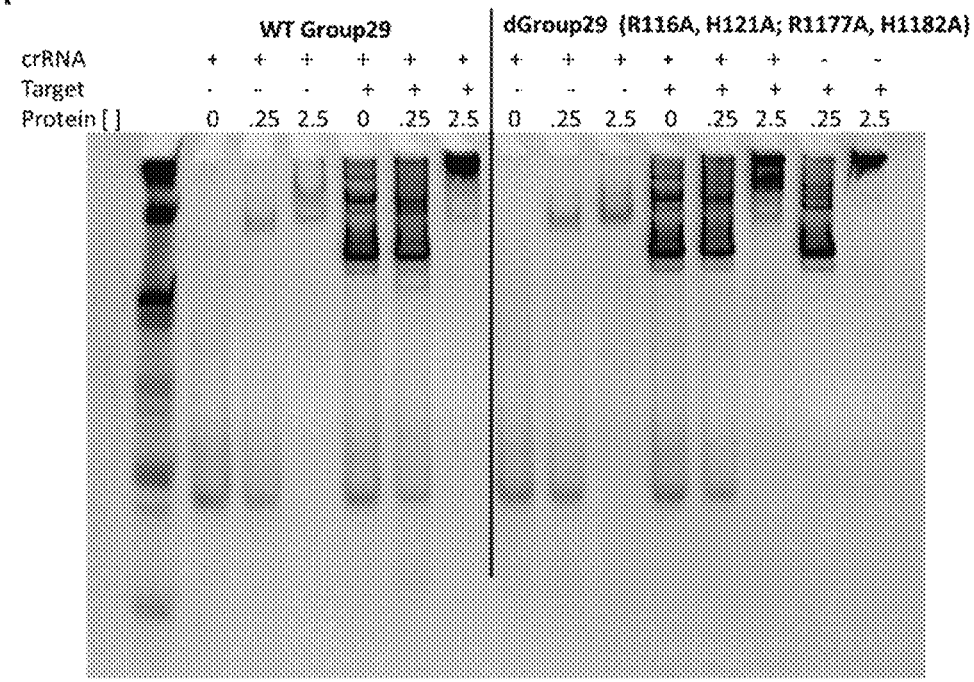
FIGS. 36A-36D FIG. 36A show results of binding assay of Group 29 effector (from *Bergeyella zoohelcum* ATCC 43767) to EGFP target via EMSA at indicated effector protein concentrations. Left panel: wild type Group 29 effector protein. Right panel: mutated Group 29 effector protein (R116A; H121A; R1177A; H1182A).

Protocol for FIG. 36A/C: EMSA Gel shift. Testing binding of the WT and dead proteins to the crRNA and crRNA+target using EGFP1 target and T2 crRNA.

PROTEIN Concentration Variation IVC Protocol
1. Normalize short crRNA to 50 ng/uL (Dil 8 uL crRNA with 8 uL H2O)
2. Normalize E1 target to 125 ng/uL (1 uL+7 uL H2O)
3. Make 10× buffer+DTT (10 uL DTT+90 10×)
4. Make Master Mix EGFP Target 1

| RNAse Inhibitor | 5 uL | 65 uL |
| 10x Buffer w/DTT | 5 uL | 65 uL |
| ddH2O | 33 uL × 13 | 429 uL |
| crRNA (T2) | 1 uL | 13 uL |
| Total | 44 uL | |

Layout:

| Lane | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| crRNA | + | + | + | + | + | + | + | + | + | + | + | + | − | − |
| Target | − | − | − | + | + | + | − | − | − | + | + | + | + | + |
| protein | WT | WT | WT | WT | WT | WT | D | D | D | D | D | D | D | D |
|  | 0 | .25 | 2.5 | 0 | .25 | 2.5 | 0 | .25 | 2.5 | 0 | .25 | 2.5 | .25 | 2.5 |

1. Pipette out 44 uL MM.
2. Add either 1 uL of dH2O or E1 target.
3. Make protein dilutions. (WT=1 ug/uL) (D=6 ug/uL)
   a. WT0: 5.5 uL 2M NaCl, 5.5 uL H2O
   b. WT.25: 0.55 uL prot, 4.95 2M NaCl, 5.5 uL H2O
   c. WT2.5: 5.5 uL prot, 5.5 uL H2O
   d. D0: 5.5 uL 2M NaCl, 5.5 uL H2O
   e. D.25: 8.5 uL NaCL, 8.5 uL H2O. Take out 1.5 uL. Make dil 0.5 uL prot+4.5 uL 50/50 mix.
   f. D2.5: 1.5+8.1 2M NaCl, 7.4 uL H2O
4. Pipette 5 uL per each protein solution into wells.
5. Mix components. Incubate for 30 minutes.
6. Set up gel(s).
7. Remove 10 uL of sample, mix 1 uL of new concentrated loading dye (glycerol and color).
8. Load 10 uL per lane. Load tightly.
9. Run gel at 180V for 45 minutes at 42° C.
10. Take out gels and wash into DI water.
11. Image downstairs no later than 1 hr after finishing gel.

FIG. 36A shows the results of a binding assay of the CRISPR complex (or individual components thereof) with an EGFP RNA target. EMSA was performed including one or more of Group 29 protein (purified from *Bergeyella zoohelcum* ATCC 43767) as the indicated concentrations, EGFP target, and crRNA. The binding assay reaction mixture contained 50 ng crRNA, 125 ng target (if present). Addition of 0.25 ug of protein corresponds to ~1:1:1 molar ratio protein:crRNA:target. Addition of 2.5 ug of protein corresponds to ~10:1:1 molar ratio protein:crRNA:target. Binding assays were performed for 30 minutes in a buffer containing 100 mM NaCl, 1 mM DTT, Tris-HCl pH7.5, 0.1% BSA. Binding of wild type Group 29 protein (left panel of FIG. 36) and mutated Group 29 protein (right panel of FIG. 36) was evaluated. Mutated Group 29 protein contained the following mutations: R116A, H121A, R1177A, and H1182A. From FIG. 36 it seems that mutated Group 29 protein (dGroup 29) binds crRNA, crRNA and its target RNA in complex. Binding is not eliminated by making mutations in the HEPN domain. FIG. 36C shows similar results for HEPN domain 2 mutant Group 29 protein (i.e. having mutations R1177A, H1182A).

Figure 36B:
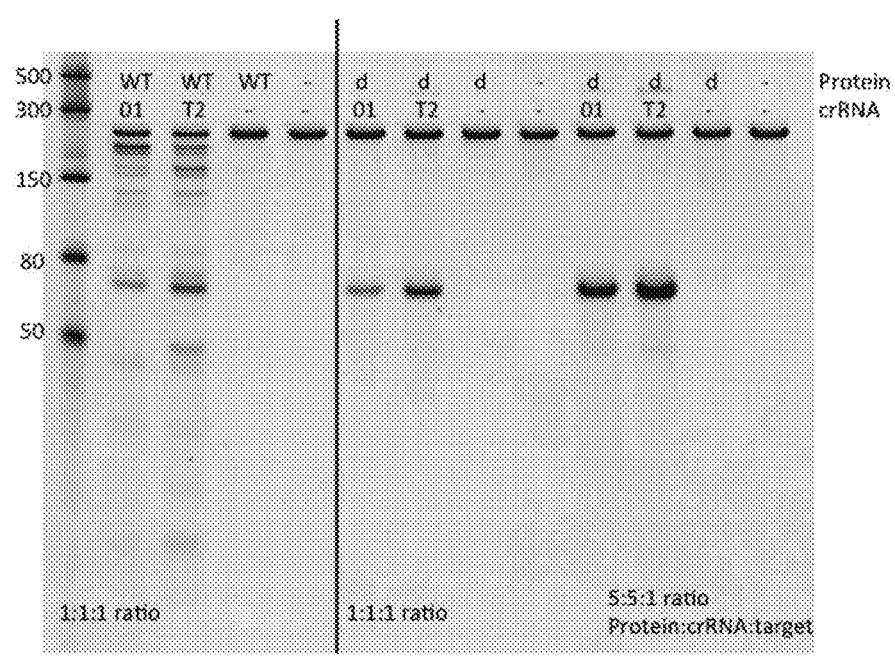
Figure 36C:
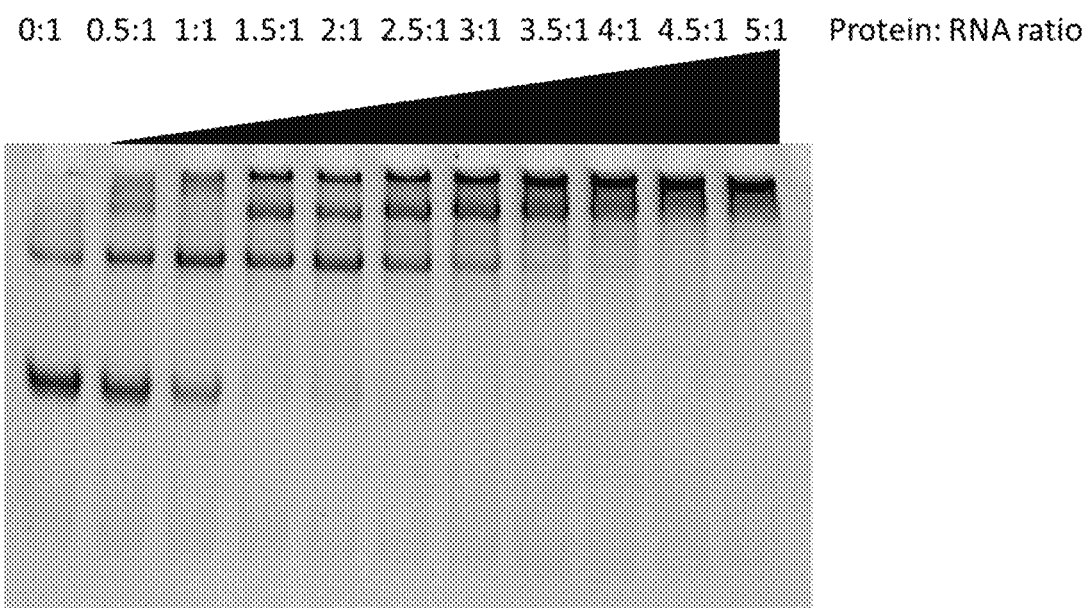

Protocol for FIG. 36B/D: Protocol for testing if dGroup29 cleaves protein Now salt concentration will be 50 mM (2.708 uL of 2M NaCl in a 100 uL rxn)
1. Normalize short crRNA to 36.5 ng/uL (5 uL in 8.7 uL ddH2O).
2. Dilute frozen protein.
   a. WT: 1.08 uL prot+2.92 H2O
   b. D 0.27: 1 uL above mix+4 uL S200
   c. d 1.35: 1.35 uL prot+4.65 S200 buffer
3. Normalize each PAM library to 100 ng/uL.
4. Make 10× Buffer w/DTT (Add 10 uL DTT to 90 uL of 10× buffer without DTT).
5. Make Master Mixes:

EGFP Target 1

|  | | |
|---|---|---|
| RNAse Inhibitor | 1 uL | 14 uL |
| 10x Buffer w/DTT | 1 uL | 14 uL |
| ddH2O | 5 uL × 14 | 70 uL |
| E1 (100 ng/uL) | 1 uL | 14 uL |
| Total | 8 uL | |

Layout:

| Gel 1 | 1 | 2 | 3 | 4 | 5 | 6 | 7 | 8 | 9 | 10 | 11 | 12 |
|---|---|---|---|---|---|---|---|---|---|---|---|---|
| Template | + | + | + | + | + | + | + | + | + | + | + | + |
| Protein | WT .27 ug | WT .27 ug | WT .27 ug | − | d .27 ug | d .27 ug | d .27 ug | − | d 1.3 ug | d 1.3 ug | d 1.3 ug | − |
| + RNA | + 01 | + T2 | − | − | + 01 | + T2 | − | − | + 01 | + T2 | + − | − |

1. Aliquot 8 uL MM.
2. Add 1 uL of protein or salt to each well.
3. Add 1 uL of short crRNA (36.5 ng/uL) or ddH2O to each well.
4. Mix components.
5. Incubate for 60 min at 37° C. Then heat inactivate for 5 minutes at 85° C.
6. Prot K treat: 1 uL per sample for 15 min @ RT.
7. Run TBE urea gel.

Figure 36D:
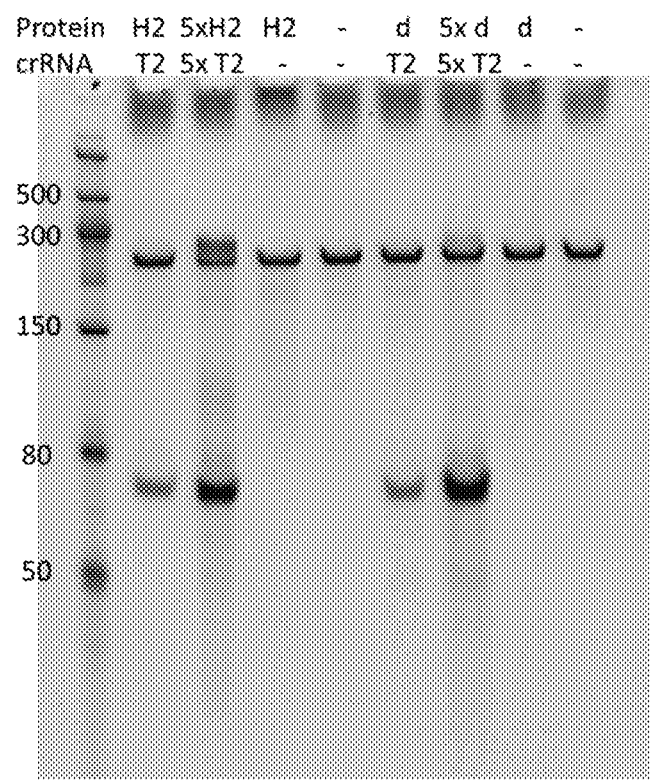

FIG. 36B shows the results of an in vitro cleavage assay of EGFP RNA by Group 29 proteins (purified from *Bergeyella zoohelcum* ATCC 43767), in which wild type and mutated Group 29 proteins were evaluated. Mutated Group 29 effector harbored the following mutations: R116A, H121A, R1177A, and H1182A. two different crRNAs were used as indicated. Different component ratios were tested, as indicated. Assay was evaluated after incubation for 60 minutes; buffer used was: 50 mM NaCl, 1 mM DTT, Tris-HCl pH7.5, 0.1% BSA. From FIG. 36B can be concluded that the mutant Group 29 effector did not cut target RNA, irrespective of component ratios. FIG. 36D shows similar results for HEPN domain 2 mutant Group 29 protein (i.e. having mutations R1177A, H1182A).

Figure 37:
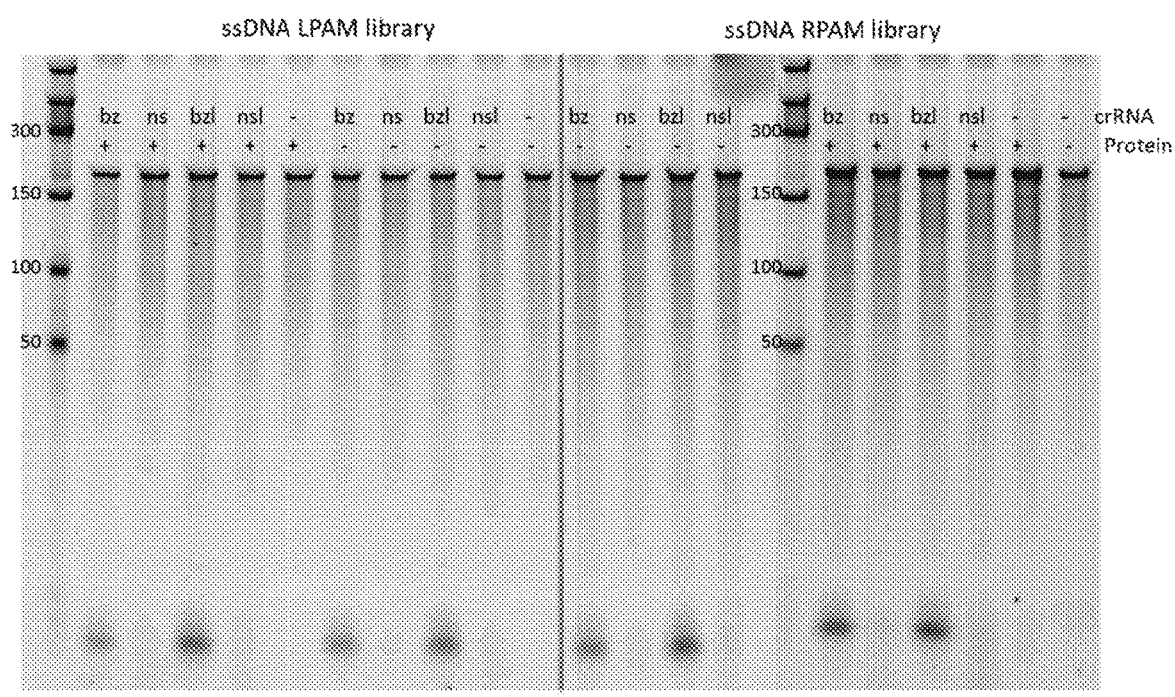
FIG. 37 shows results of cleavage assay of a single stranded DNA LPAM library (left panel) and single stranded DNA RPAM library (right panel) of Group 29 effector protein (from *Bergeyella zoohelcum* ATCC 43767). bz=targeted crRNA. ns=nonspecific crRNA. bzl=targeted crRNA with long DR. nsl=nonspecific crRNA with long DR.

Protocol for FIG. 37: IVC DNA; testing ssDNA cleavage.
Long Vs. Short crRNA IVC Protocol
Linearize plasmid, Purify, Run on Gel to confirm cut
Normalize short crRNA to 100 ng/uL, long crRNA to 200 ng/uL
Make Master Mixes:

| 5'PAM MM | | 3'PAM MM | |
|---|---|---|---|
| 10x pH 7.9 | 2 uL   24 uL | 10x pH 7.9 | 2 uL   24 uL |
| NaCl | 1 uL   12 uL | NaCl | 1 uL   12 uL |
| MgCl2 | 1 uL × 12   12 uL | MgCl2 | 1 uL × 12   12 uL |
| DNA Target (25 ng/uL) | 8 uL | DNA Target | 8 uL |
| H2O | 2 uL | H2O | 2 uL |
| Total | 14 uL | Total | 14 uL |

Layout:

|  | 1 | 2 | 3 | 4 | 5 | 6 | 7 | 8 | 9 | 10 |
|---|---|---|---|---|---|---|---|---|---|---|
| DNA target | + | + | + | + | + | + | + | + | + | + |
| crRNA | short | short (NS) | long | long (NS) | − | short | short (NS) | long | long (NS) | − |
| protein | + | + | + | + | + | − | − | − | − | − |

Aliquot 14 uL of MM per well (10 wells of each type of PAM library).
Dilute protein. Need 10 samples total. Mix 6 uL protein with 18 uL of H2O. Add 2 uL to each well requiring protein.
Add protein buffer to other wells (2 uL) (1:4 dilution of 500 mM S200 protein solution).
Add 4 uL of proper crRNA.
Mix components. Incubate at 370 C for 1 hr. Protein inactivation at 85° C. for 5 min.
Incubate with RNAse A. Dilute 10 uL stock with 50 uL of H2O. Add 1 uL per well. Incubate 30 min at 37° C.)
Incubate with Proteinase K (15 min RT).
Run on denaturing gel.

FIG. 37 shows the results of an in vitro cleavage assay of ssDNA by Group 29 proteins (purified from *Bergeyella zoohelcum* ATCC 43767). Binding to a ssDNA LPAM library (left panel of FIG. 37) and a ssDNA RPAM library (right panel of FIG. 37) was evaluated. FIG. 37 indicates that Group 29 proteins do not cut ssDNA, irrespective of direct repeat lenth.

Protocol for FIG. 38: IVC; testing cleavage of CRISPR array
1. Synthesize crRNAs
2. Normalize crRNAs to 100 ng/uL
3. Make protein concentrations:
   1: 1 uL stock
   2: 0.65 uL stock+0.35 uL 2M NaCl
   3: Add 0.5 uL stock+2 uL 2M NaCl. Take 1 uL
   4: 0.65 uL 200 ng/uL+0.35 uL 2M NaCl
   5/6: 1 uL of 2M
4. Make 10× buffer+DTT
5. Make Master Mix Mg MM

|  | | |
|---|---|---|
| 10x Buffer | 2 uL | 14 uL |
| RNAse Inh. | 1 uL | 7 uL |
| H2O | 15 uL × 7 | 105 uL |
| Total | 18 uL | |

Layout:

| Lane | 1 | 2 | 3 | 4 | 5 | 6 |
|---|---|---|---|---|---|---|
| Time | 60 min | 60 min | 60 min | 60 min | 60 min | 60 min |
| crRNA | FR1 | FR2 | FR1 | FR2 | FR1 | FR2 |
| Protein | 1 ug (5:1) | .65 ug (5:1) | 200 ng (1:1) | 130 ng (1:1) | – | – |

1. Add 1 uL of target crRNA (100 ng per reaction).
2. Add protein or Salt buffer to other wells (1 uL).
3. Mix components. Incubate for 60 min at 370 C then heat for 5 min at 85° C., then add 1 uL of Proteinase K at RT (15 min).
4. Set up gel(s). Heat at 42° C. When 15 min left on incubation, start running gel (to stabilize internal temperature).
5. Remove 7 uL of mix, add 7 uL of 2× loading dye.
6. Heat 10 uL at 95° C. for 5 minutes.
7. Chill on ice and spin down.
8. Load 12 uL per lane. Load tightly.
9. Run gel at 180V for 45 minutes at 42° C.

The following LPAM, RPAM and crRNA sequences are artificial sequences.

```
LPAM dsDNA Sequence*
GGGcgatggtccataccttagatgcgttagcattaatcaggcaacggctc
tctagatagNNNNNNNgtaggctctttgtgcctctacgccatctccatag
agccctcaaccggagtttgaagcatggcttctaactttactcagttcgtt
ctcgtcgacaatggcggaactggcgacgtgact (SEQ ID NO: 200)

RPAM dsDNA Sequence*
GGGcgatggtccataccttagatgcgttagcattaatcaggcaacggctc
tctagataggtaggctctttgtgcctctacgccatctccNNNNNNNatag
agccctcaaccggagtttgaagcatggcttctaactttactcagttcgtt
ctcgtcgacaatggcggaactggcgacgtgact  (SEQ ID NO: 201)

LPAM ss/dsDNA Sequence*
TAATACGACTCACTATAGGGcgatggtccataccttagatgcgttagcat
taatcaggcaacggctctctagatagNNNNNNNgtaggctctttgtgcct
ctacgccatctccatagagccctcaaccggagtttgaagcatggcttcta
actttactcagttcgttctcgtcgacaatggcggaactggcgacgtgact
(SEQ ID NO: 202)

RPAM ss/dsDNA Sequence*
TAATACGACTCACTATAGGGcgatggtccataccttagatgcgttagcat
taatcaggcaacggctctctagataggtaggctctttgtgcctctacgcc
atctccNNNNNNNatagagccctcaaccggagtttgaagcatggcttcta
actttactcagttcgttctcgtcgacaatggcggaactggcgacgtgact
(SEQ ID NO: 203)

crRNA DR Sequence of BZ (short)
GUUGGAACUGCUCUCAUUUUGGAGGGUAAUCACAAC
(SEQ ID NO: 204)

crRNA DR Sequence of BZ (long)
GUUGGAACUGCUCUCAUUUUAUUCGUGAAGUUUUUAUUUGUUUUCAAA
GGAACUCAUGAAUACAGAGUAUUUGGAGGGUAAUAACAAC
(SEQ ID NO: 205)

crRNA Sequence
5'-guide sequence-DR sequence-3'
*Guide sequences reverse complements (in RNA) of highlighted
target sequences
```

Figure 38A:
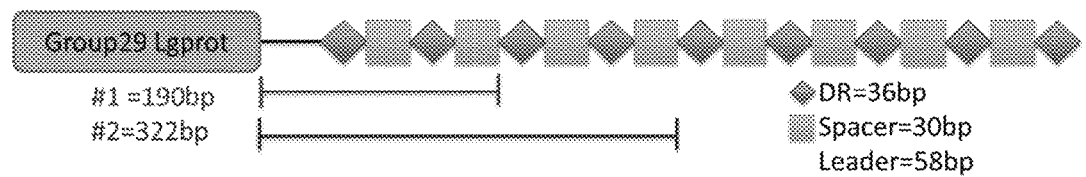
FIGS. 38A and 38B show that Group 29 effector proteins process their own crRNA.
Figure 38B:
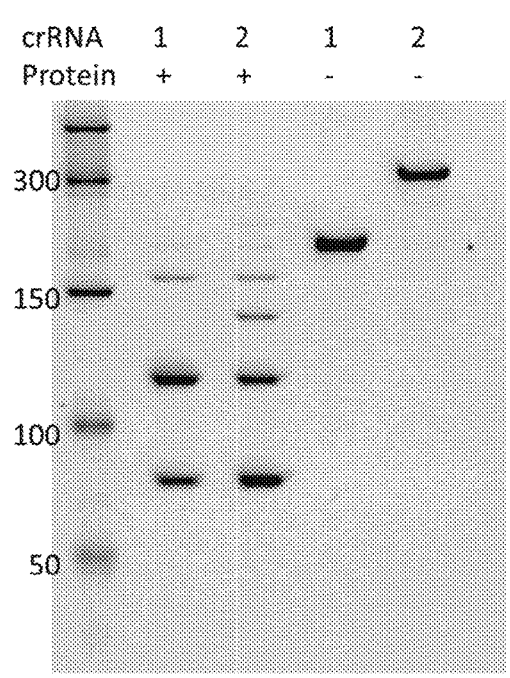

FIG. 38 shows that Group 29 proteins (purified from *Bergeyella zoohelcum* ATCC 43767) process their own crRNA. The Group 29 native locus is schematically represented in FIG. 38A. Two different CRISPR array fragments were evaluated for processing by Group 29 protein (indicated as #1 and #2). FIG. 38B indicates that both fragments are efficiently processed. A mature crRNA is about 66nt.

Protocol of FIG. 39: Protocol for repeating EGFP cleavage

Now salt concentration will be 50 mM (2.708 uL of 2M NaCl in a 100 uL rxn)
1. Normalize short crRNA to 36.5 ng/uL (5 uL in 8.7 uL ddH2O).
2. Dilute frozen protein. (8.1 uL in 21.9 H2O.) Need 24 (make 30) samples (1 uL per sample), 0.27 ug per rxn. New stock is at 1 ug/uL; 2000 mM NaCl.
3. Normalize each PAM library to 100 ng/uL (10 uL in 90 uL ddH2O)
4. Make 10× Buffer w/DTT (Add 10 uL DTT to 90 uL of 10× buffer without DTT).
5. Make Master Mixes:

EGFP Target 1

| | | |
|---|---|---|
| RNAse Inhibitor | 1 uL | 20 uL |
| 10x Buffer w/DTT | 1 uL | 20 uL |
| ddH2O | 5 uL × 20 | 120 uL |
| E1 (100 ng/uL) | 1 uL | 20 uL |
| Total | 8 uL | |

EGFP Target 1

| | | |
|---|---|---|
| RNAse Inhibitor | 1 uL | 10 uL |
| 10x Buffer w/DTT | 1 uL | 10 uL |
| ddH2O | 5 uL × 10 | 50 uL |
| E2 (100 ng/uL) | 1 uL | 10 uL |
| Total | 8 uL | |

Layout:

| Gel 1 | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| Template | 1 | 1 | 1 | 1 | 1 | 1 | 1 | 1 | 1 | 1 | 1 | 1 | 1 | 1 |
| Protein | + | + | + | + | + | + | + | + | + | + | + | + | – | – |
| RNA | T1 | T2 | T3 | T4 | T5 | T6 | 11 | 12 | 13 | 14 | 15 | 16 | – | – |

| Gel 2 | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| Template | 1 | 1 | 1 | 1 | 1 | 2 | 2 | 2 | 2 | 2 | 2 | 2 | 2 | 2 |
| Protein | + | + | + | + | − | + | + | + | + | + | + | + | + | − |
| RNA | T2 | 11 | 25 | − | − | 21 | 22 | 23 | 24 | 25 | 26 | 11 | − | − |

1. Aliquot 8 uL MM.
2. Add 1 uL of protein or ddH2O to each well.
3. Add 1 uL of short crRNA (36.5 ng/uL) or ddH2O to each well.
4. Mix components.
5. Incubate for 60 min at 37° C. Then heat inactivate for 5 minutes at 85° C.
6. Prot K treat: 1 uL per sample for 15 min @ RT.
7. Run TBE urea gel.

FIG. 39 shows the results of an in vitro cleavage assay of two different EGFP RNAs by Group 29 proteins (purified from *Bergeyella zoohelcum* ATCC 43767). EGFP RNA template 1 is about 290 nt long. EGFP RNA template 2 is about 240 nt long (see FIG. 42). Reactions were in 50 mM NaCl, pH 7.5 (10 mM Tris-HCl), 0.1% BSA, 1 mM DTT, and conducted for 60 min at 37° C. The molar ratio of protein to crRNA to target RNA was 1:1:1. Different crRNAs were evaluated, as indicated in FIG. 39. From FIG. 39 as well as Table 2, cleaving and non-cleaving guides (artificial sequences) can be distinguished.

TABLE 2

| Guide Index | Left Flank | Target | Right Flank |
|---|---|---|---|
| | | Guides that cut: | |
| T2 | GGCACAAGCT (SEQ ID NO: 206) | CGAGTACAACTACAACAGCCACAACGTCTATATCATGGCC (SEQ ID NO: 207) | (SEQ ID NO: 208) |
| 11 | ACCCTGGTGA (SEQ ID NO: 209) | ACCGCATCGAGCTGAAGGGCATCGACTTCAAGGAGCACGG (SEQ ID NO: 210) | (SEQ ID NO: 211) |
| 12 | ATCGACTTCA (SEQ ID NO: 212) | AGGAGGACGGCAACATCCTGGGGCACAAGCTGGAGTACAA (SEQ ID NO: 213) | (SEQ ID NO: 214) |
| 13 | TGGGGCACAA (SEQ ID NO: 215) | GCTGGAGTACAACTACAACAGCCACAACGTCTATATCATG (SEQ ID NO: 216) | (SEQ ID NO: 217) |
| 25 | ACCACATGAA (SEQ ID NO: 218) | GCAGCACGACTTCTTCAACTCCGCCATGCCCGAAGGCTAC (SEQ ID NO: 219) | (SEQ ID NO: 220) |
| 26 | GTCCGCCATG (SEQ ID NO: 221) | CCCGAAGGCTACGTCCAGGAGCGCACCATCTTCTTCAAGG (SEQ ID NO: 222) | (SEQ ID NO: 223) |
| | | Guides that didn't visibly cut: | |
| T1 | GCATCGACTT (SEQ ID NO: 224) | CAAGGAGGACGGCAACATCCTGGGGCACAAGCTGGAGTAC (SEQ ID NO: 225) | (SEQ ID NO: 226) |
| T3 | ACGGCAACAT (SEQ ID NO: 227) | CCTGGGGCACAAGCTGGAGTACAACTACAACAGCCACAAC (SEQ ID NO: 228) | (SEQ ID NO: 229) |
| T4 | AAGCTGGAGT (SEQ ID NO: 230) | ACAACTACAACAGCCACAACCTCTATATCATGGCCGACAA (SEQ ID NO: 231) | (SEQ ID NO: 232) |
| T5 | CGAGCTGAAG (SEQ ID NO: 233) | GGCATCGACTTCAAGGAGGACGGCAACATCCTGGGGCACA (SEQ ID NO: 234) | (SEQ ID NO: 235) |
| T6 | GGGCACAAGC (SEQ ID NO: 236) | TGGAGTACAACTACAACAGCCACAACGTCTATATCATGGC (SEQ ID NO: 237) | (SEQ ID NO: 238) |
| 14 | AGCCACAACG (SEQ ID NO: 239) | TCTATATCATGGCCGACAAGCAGAAGAACGGCATCAAGGT (SEQ ID NO: 240) | (SEQ ID NO: 241) |
| 15 | GCAGAAGAAC (SEQ ID NO: 242) | GGCATCAAGGTGAACTTCAAGATCCGCCACAACATCGAGG (SEQ ID NO: 243) | (SEQ ID NO: 244) |
| 16 | AAGATCCGCC (SEQ ID NO: 245) | ACAACATCGAGGACGGCAGCGTGCAGCTCGCCGACCACTA (SEQ ID NO: 246) | (SEQ ID NO: 247) |
| 21 | CACCTACGGC (SEQ ID NO: 248) | AAGCTGACCCTGAAGTTCATCTGCACCACCGGCAAGCTGC (SEQ ID NO: 249) | (SEQ ID NO: 250) |
| 22 | ATCTGCACCA (SEQ ID NO: 251) | CCGGCAAGCTGCCCGTGCCCTGGCCCACCCTCGTGACCAC (SEQ ID NO: 252) | (SEQ ID NO: 253) |
| 23 | TGGCCCACCC (SEQ ID NO: 254) | TCGTGACCACCCTGACCTACGGCGTGCAGTGCTTCAGCCG (SEQ ID NO: 255) | (SEQ ID NO: 256) |
| 24 | TACGGCGTGC (SEQ ID NO: 257) | AGTGCTTCAGCCGCTACCCCGACCACATGAAGCAGCACGA (SEQ ID NO: 258) | (SEQ ID NO: 259) |

Figure 40:
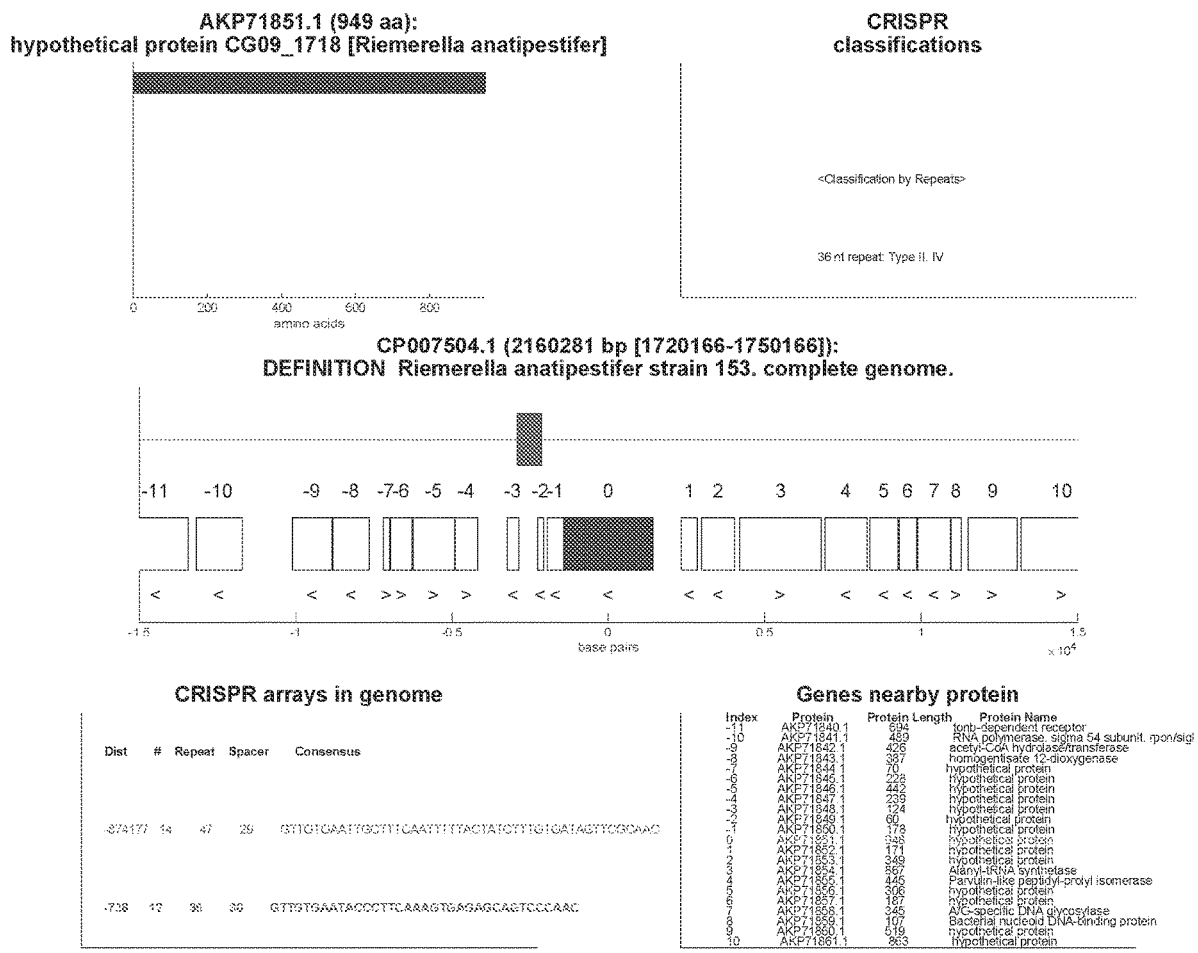
FIGS. 40A and 40B show results of cleavage assays of an EGFP RNA target by Group 29 effector (from *Bergeyella zoohelcum* ATCC 43767) with the different guides for the indicated targets.
Figure 4P:
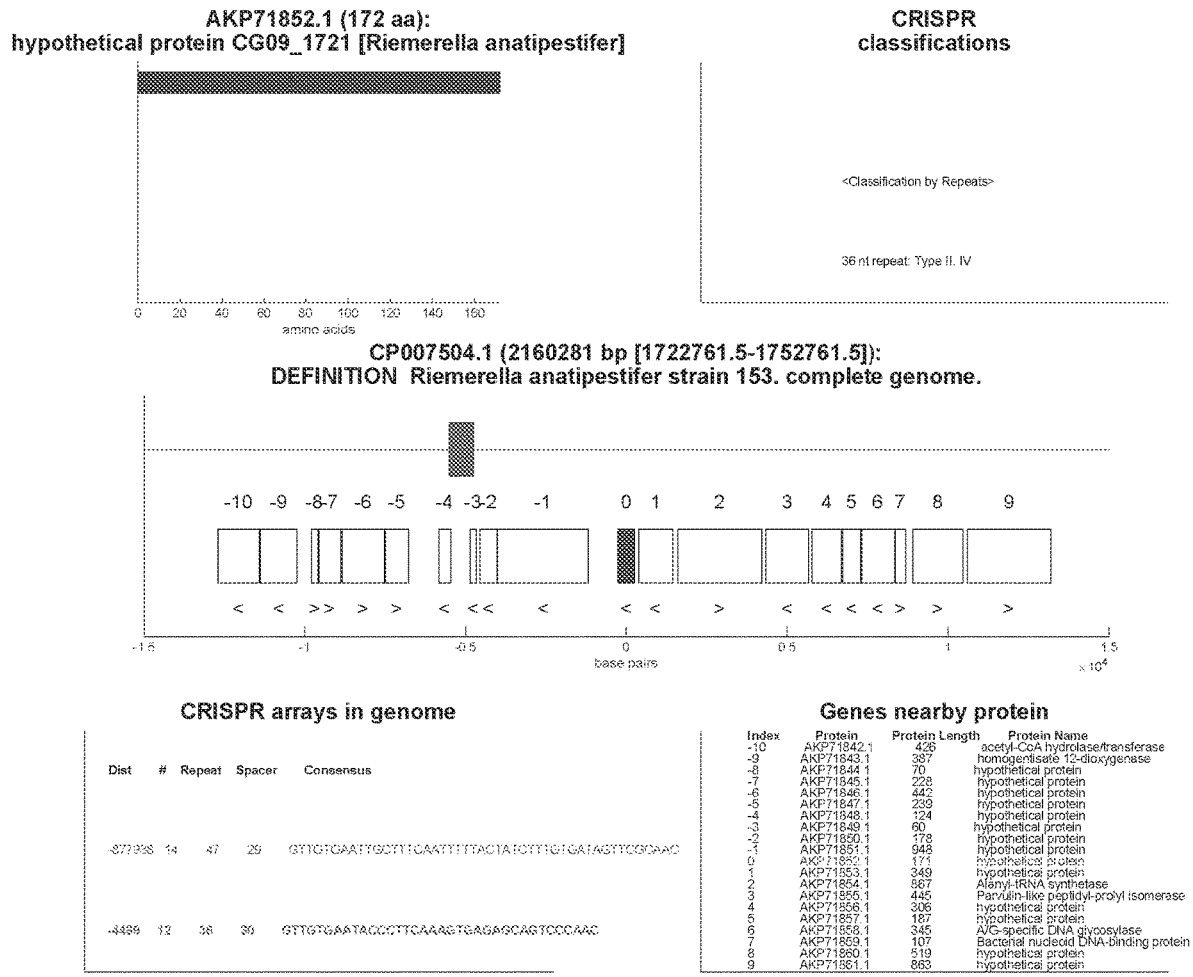
Figure 4Q:
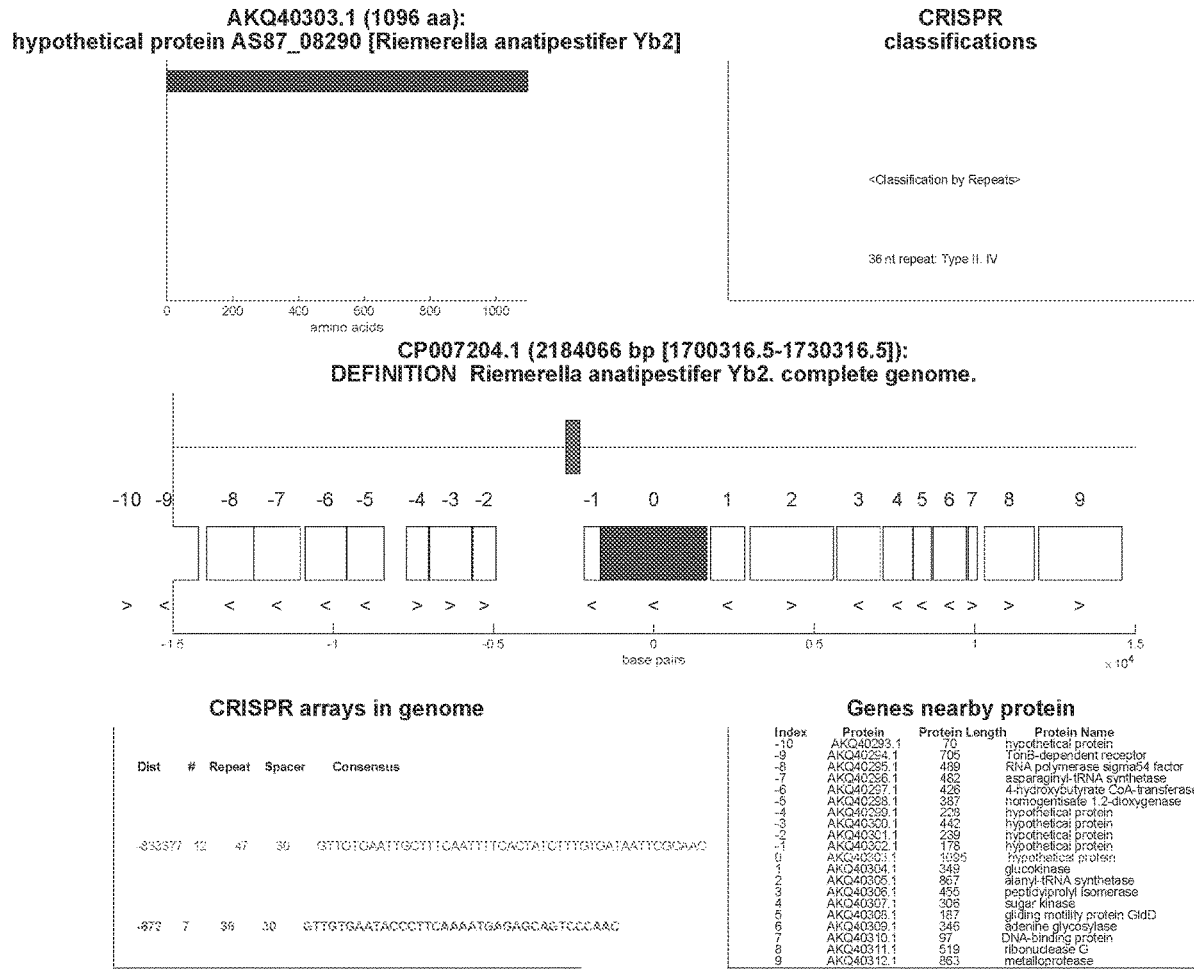
Figure 4R:
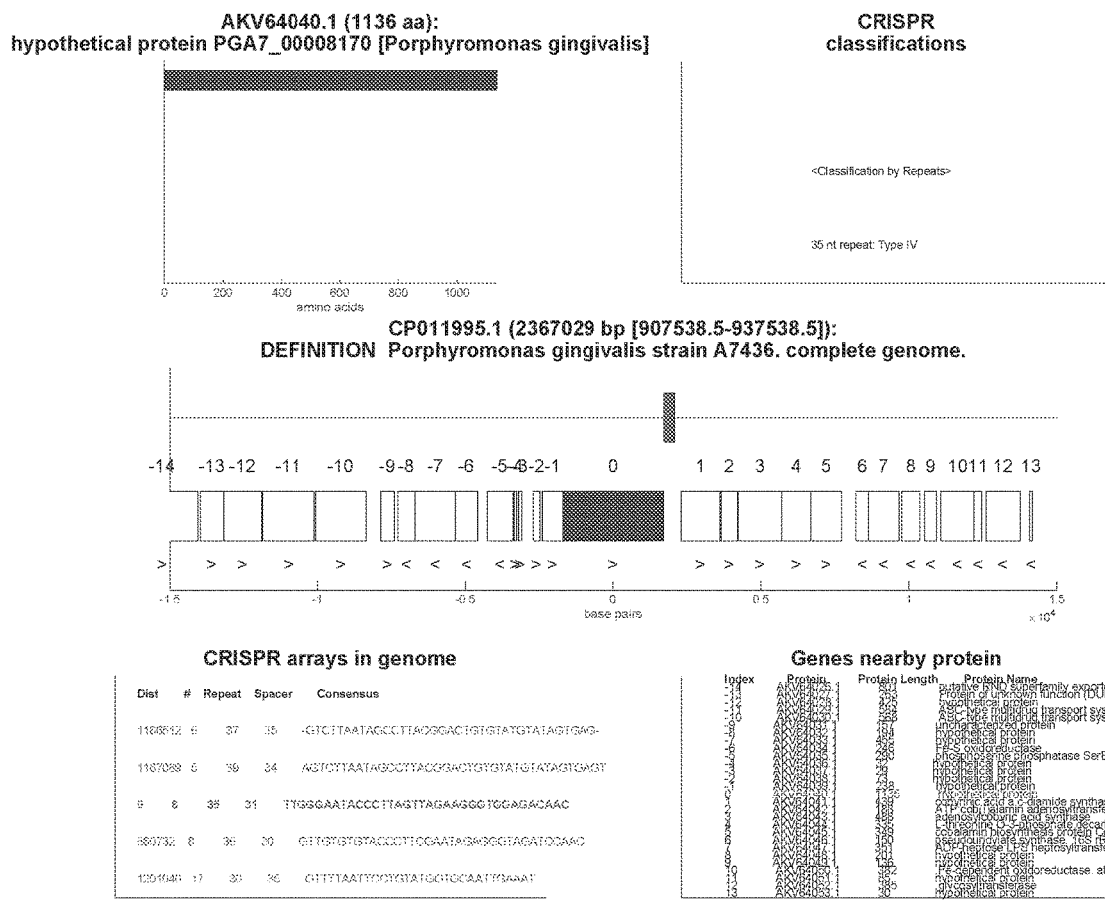
Figure 4S:
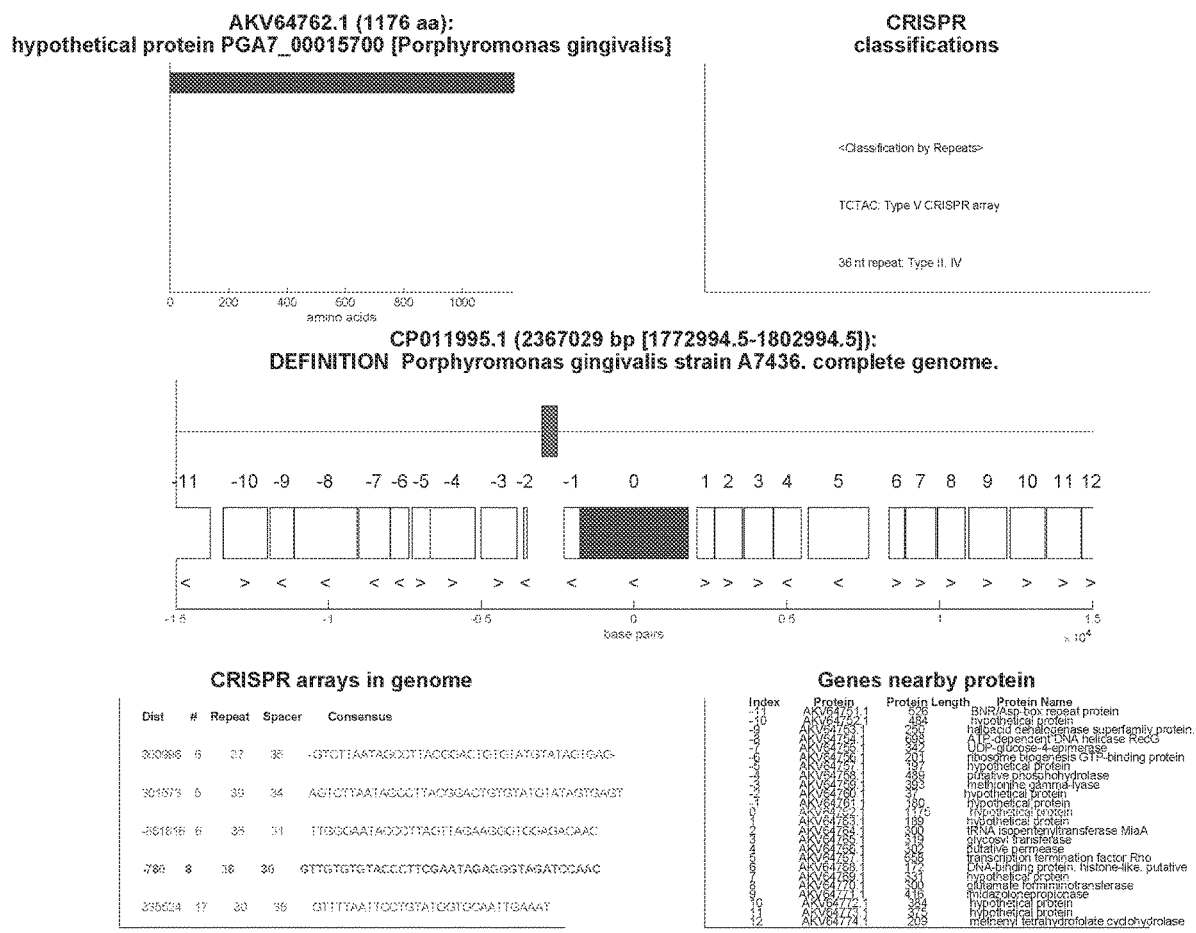
Figure 4T:
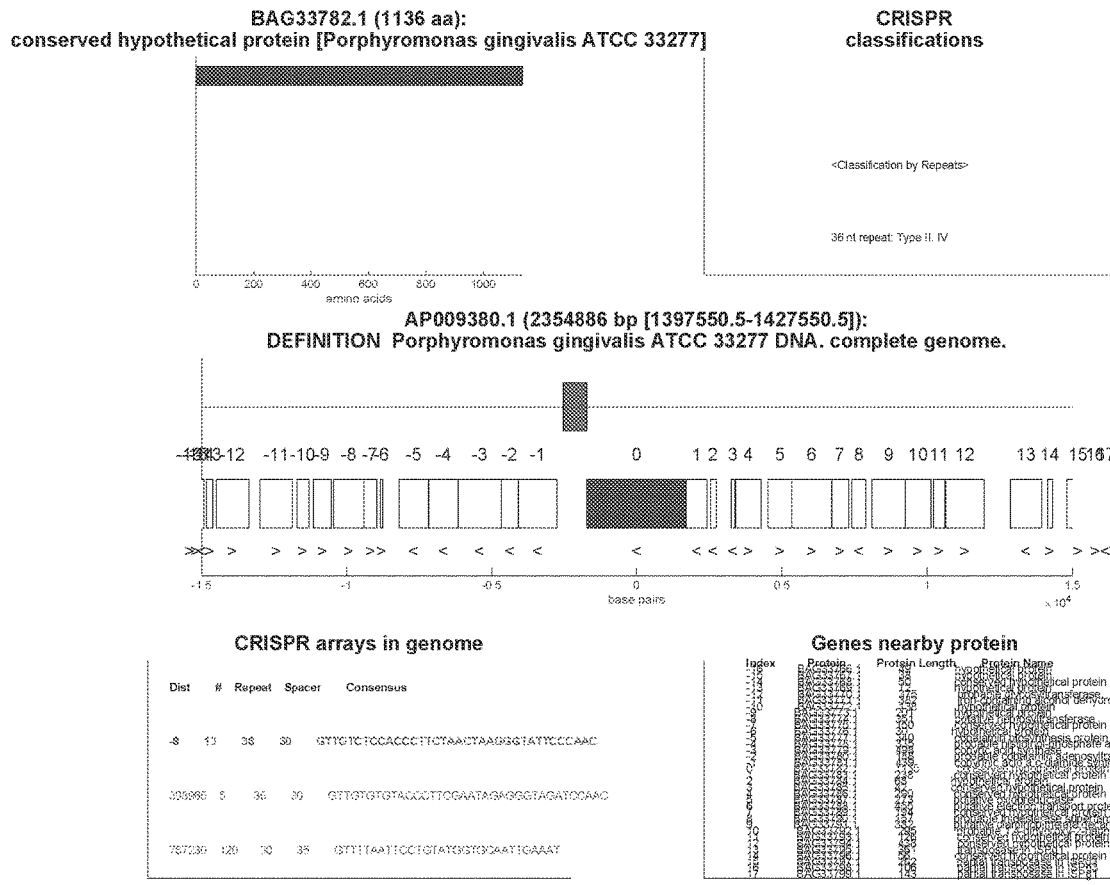
Figure 4U:
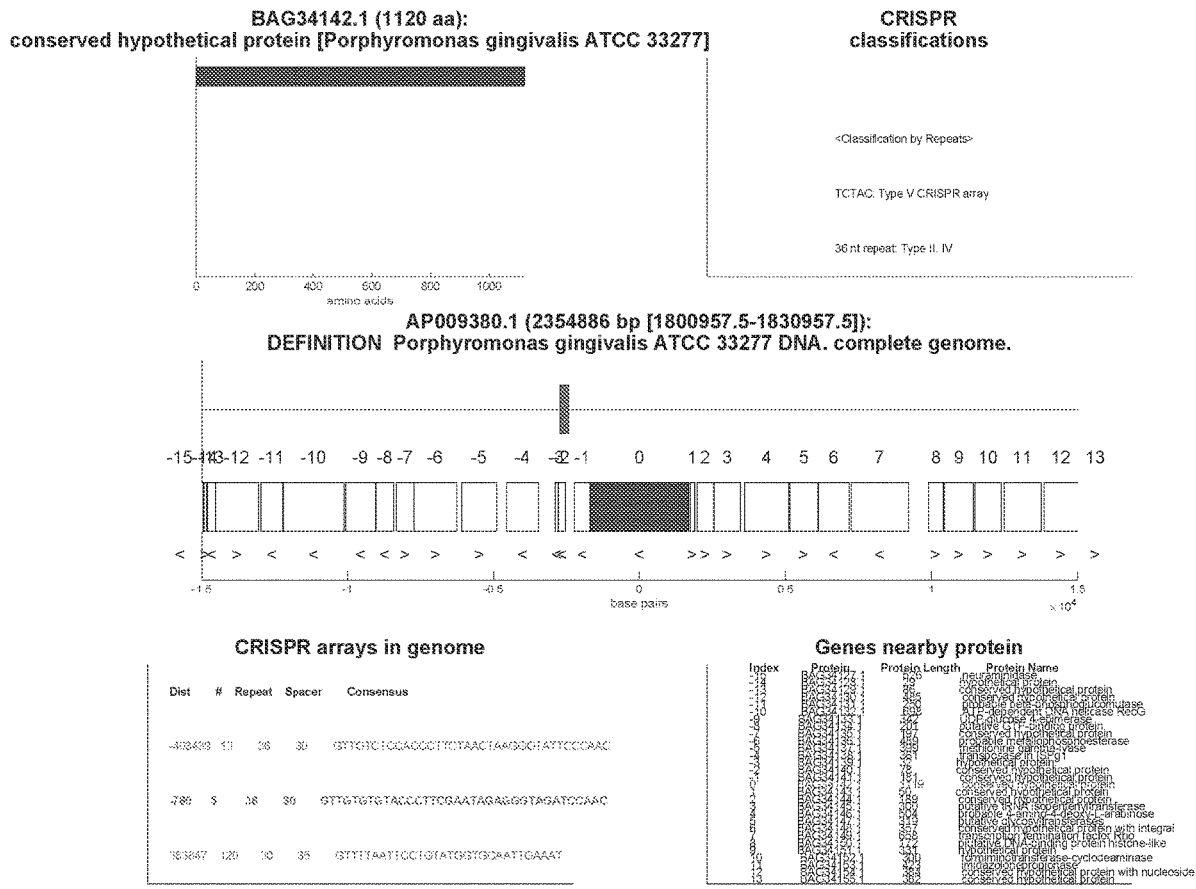
Figure 4V:
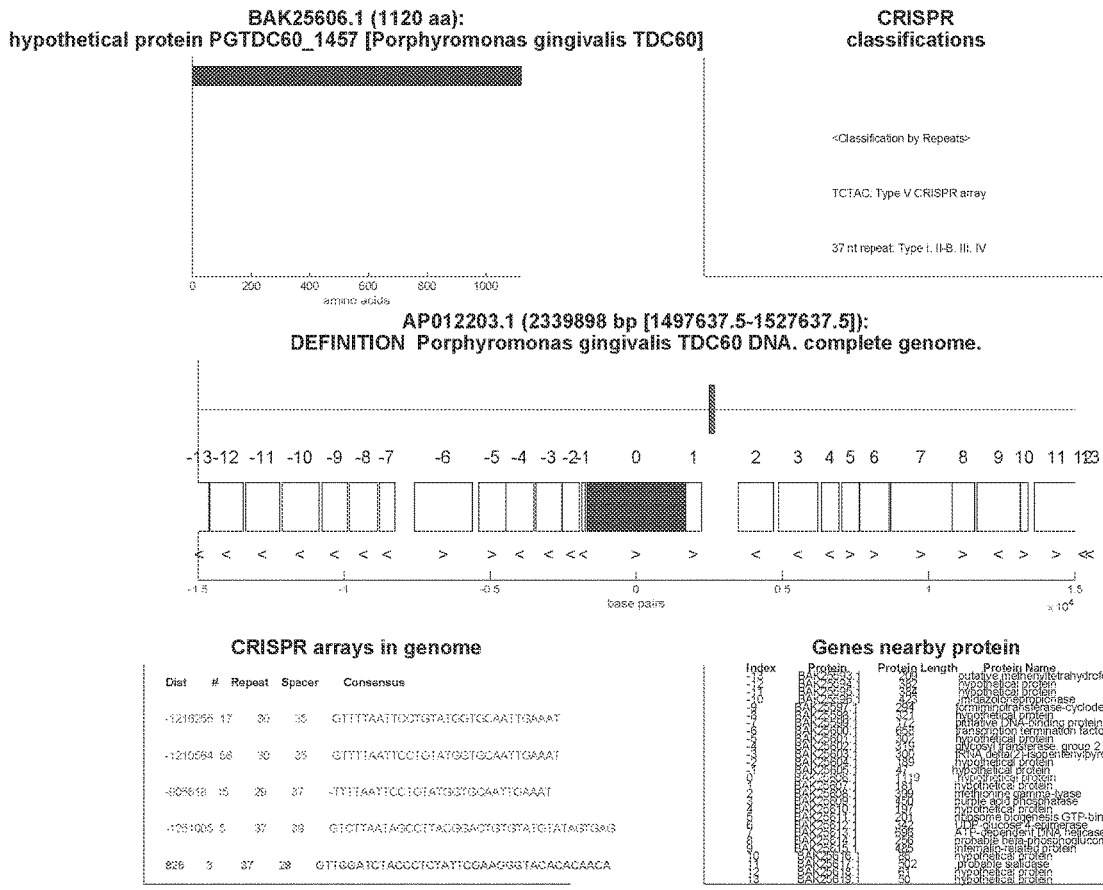
Figure 4W:
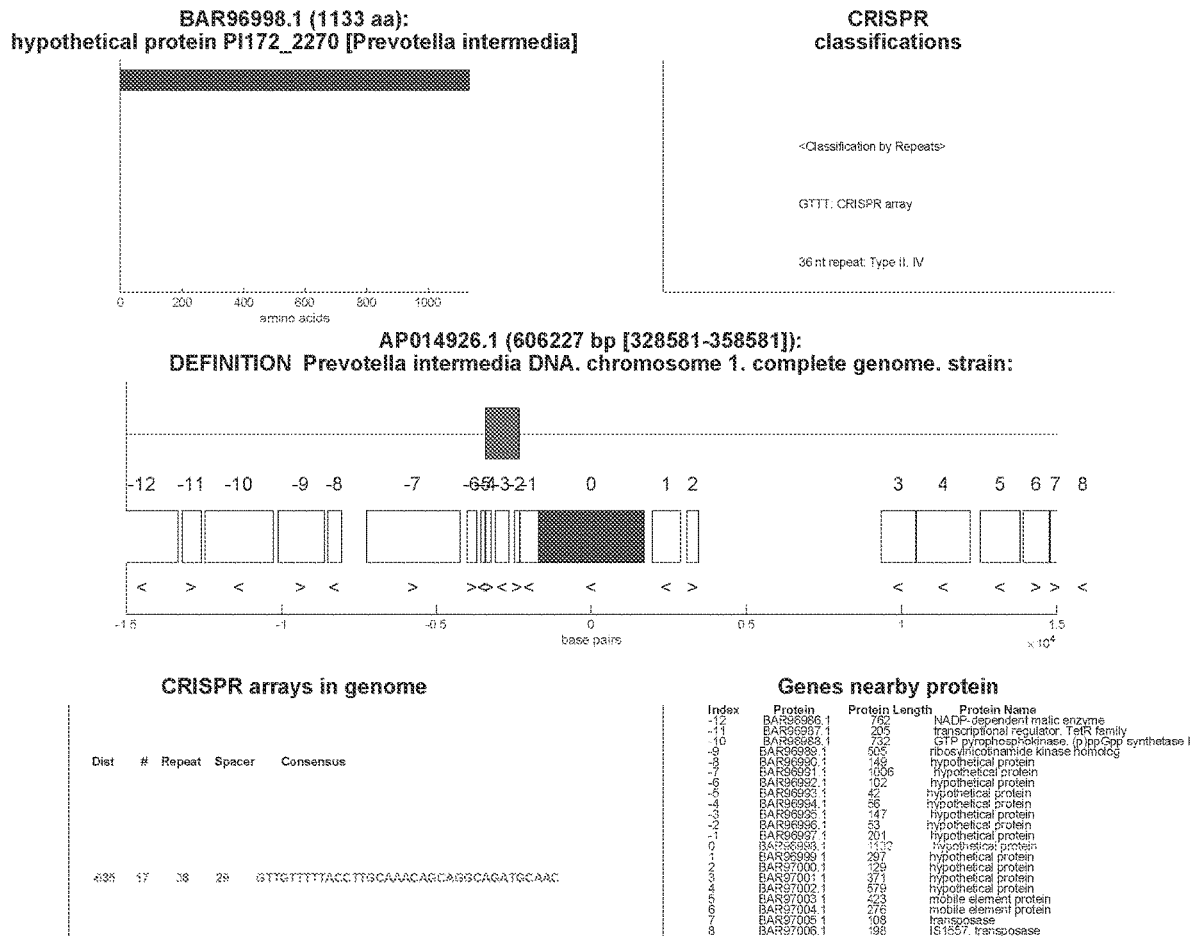
Figure 4X:
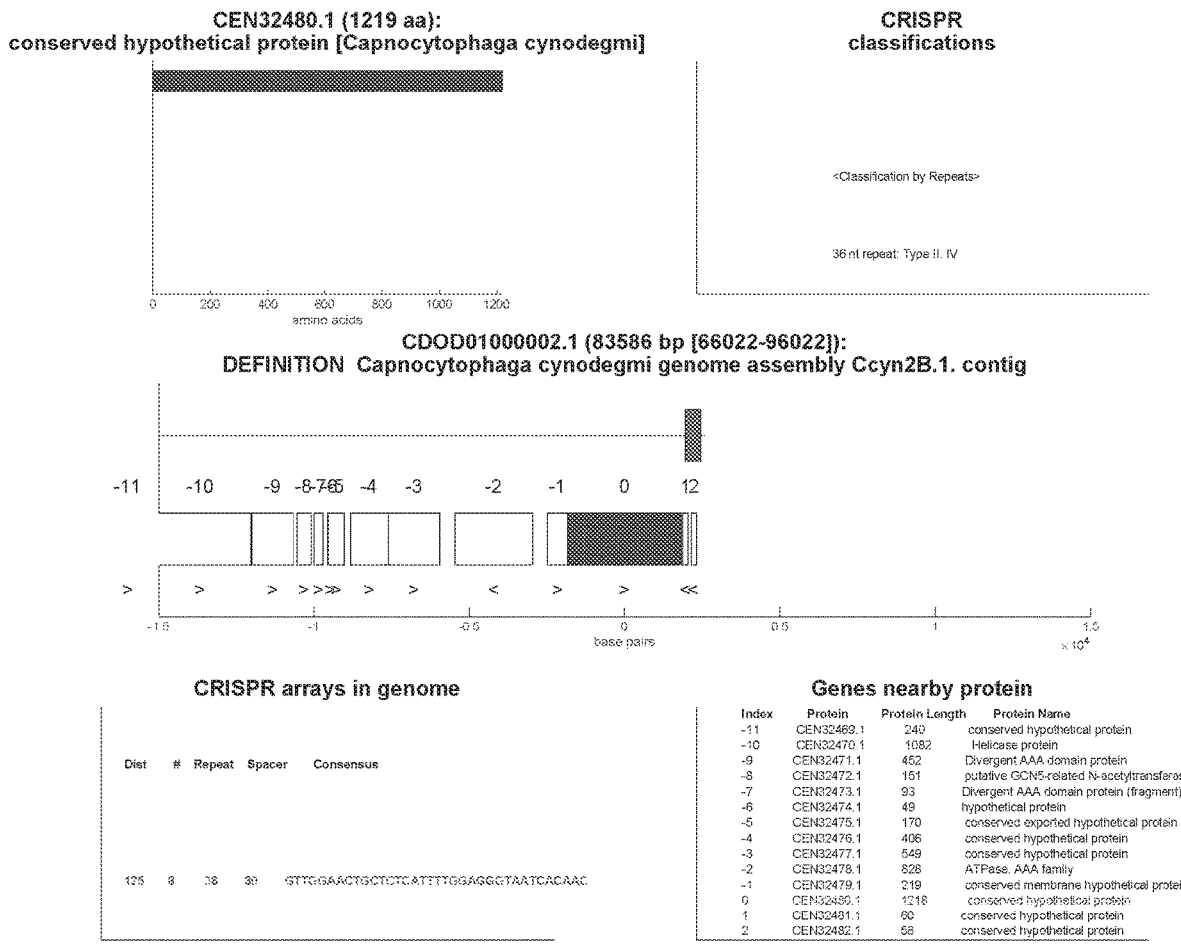
Figure 4Y:
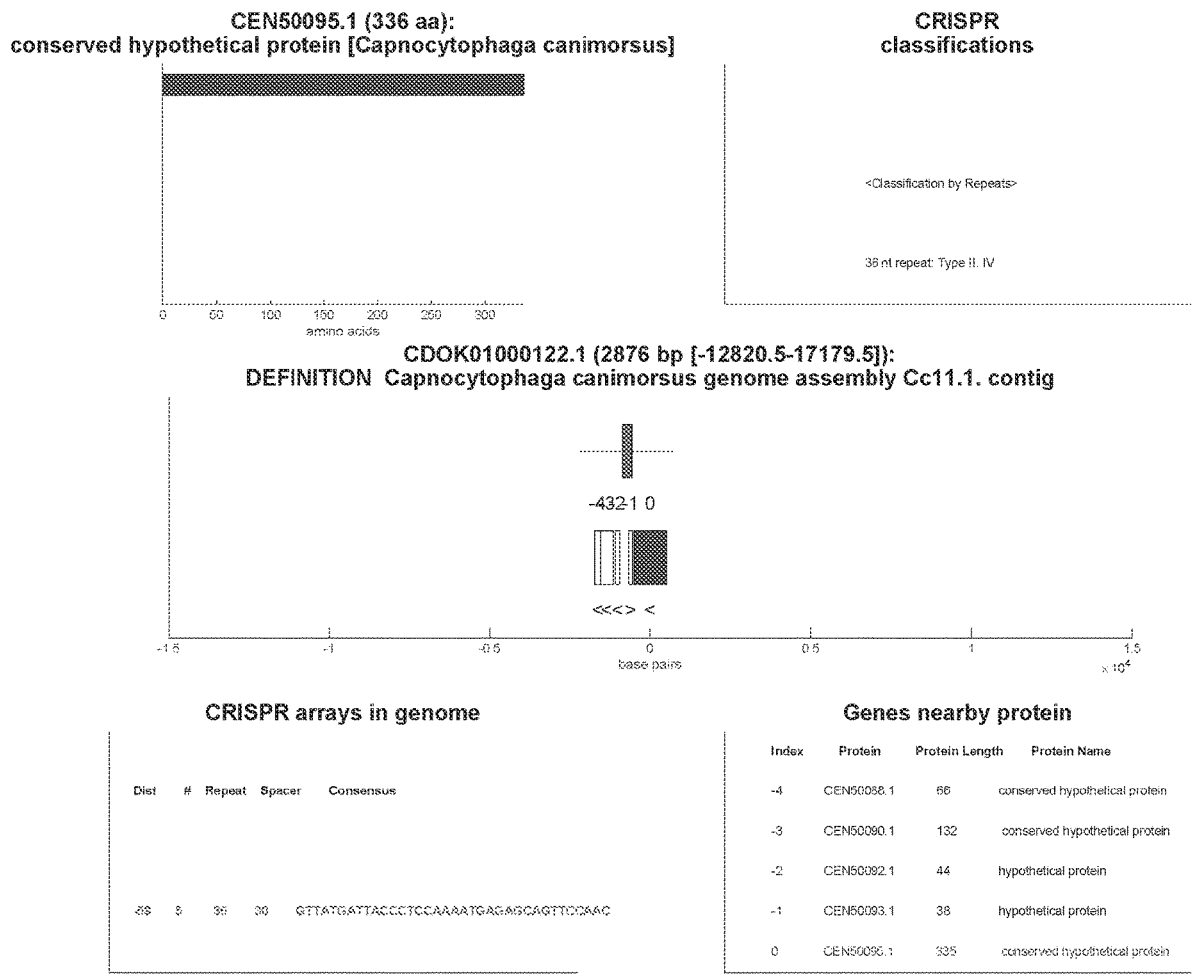
Figure 4Z:
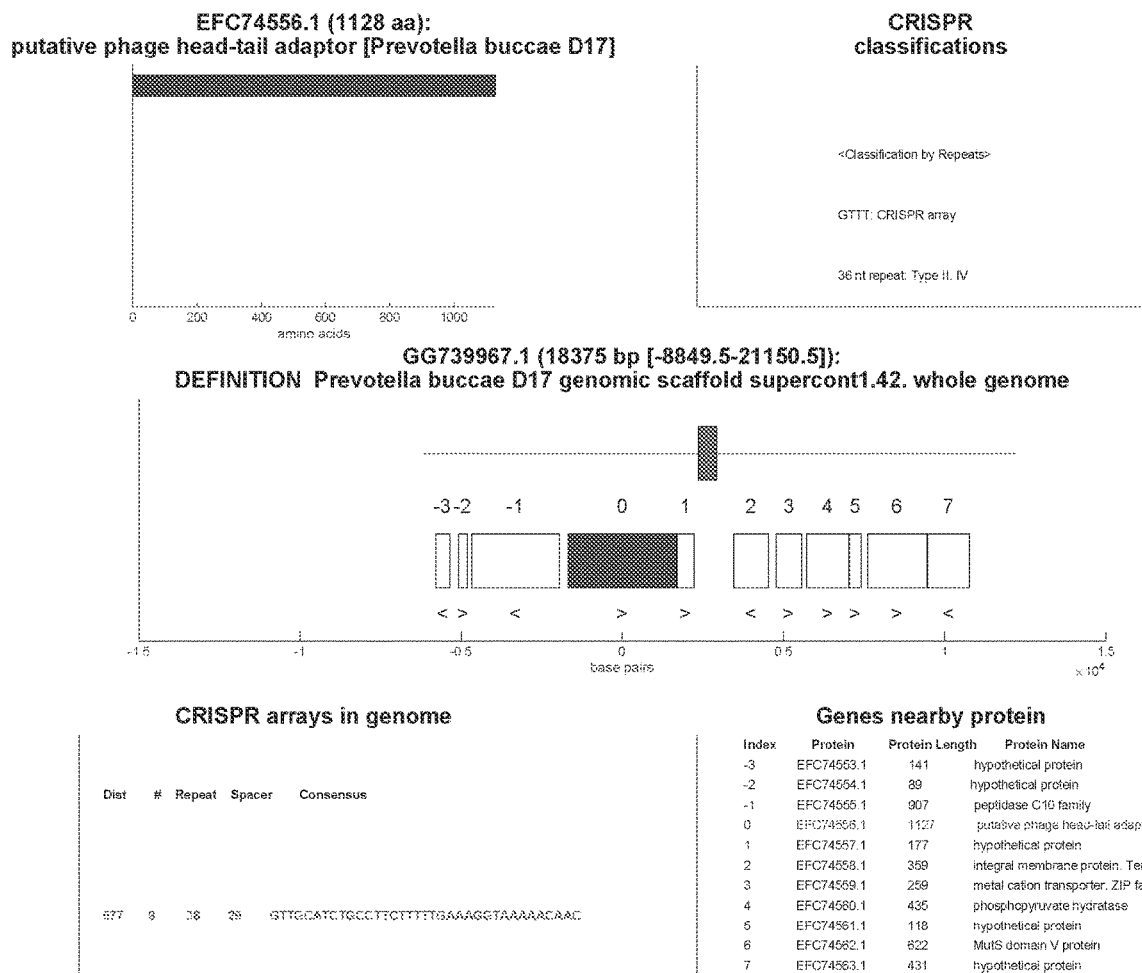
Figure 4B:
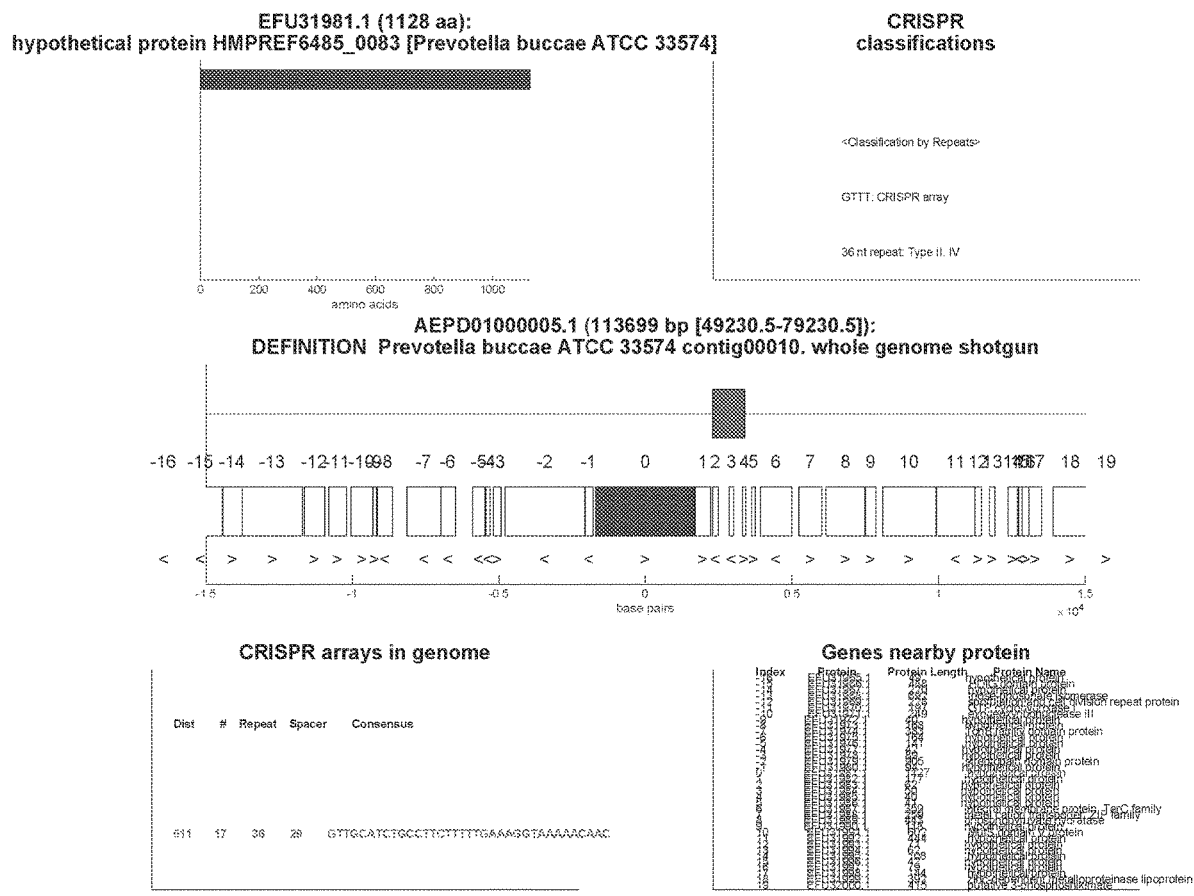
Figure 4D:
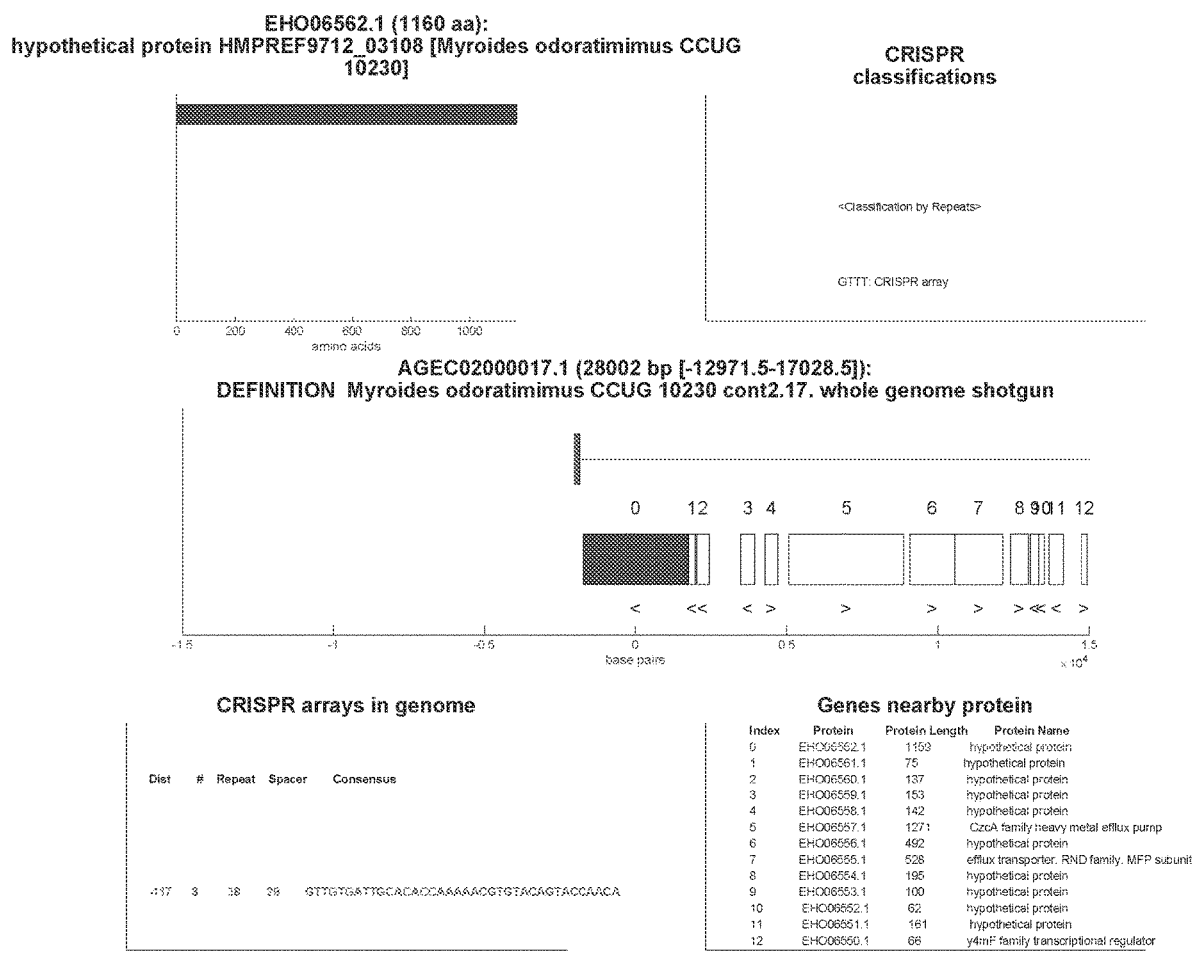
Figure 4E:
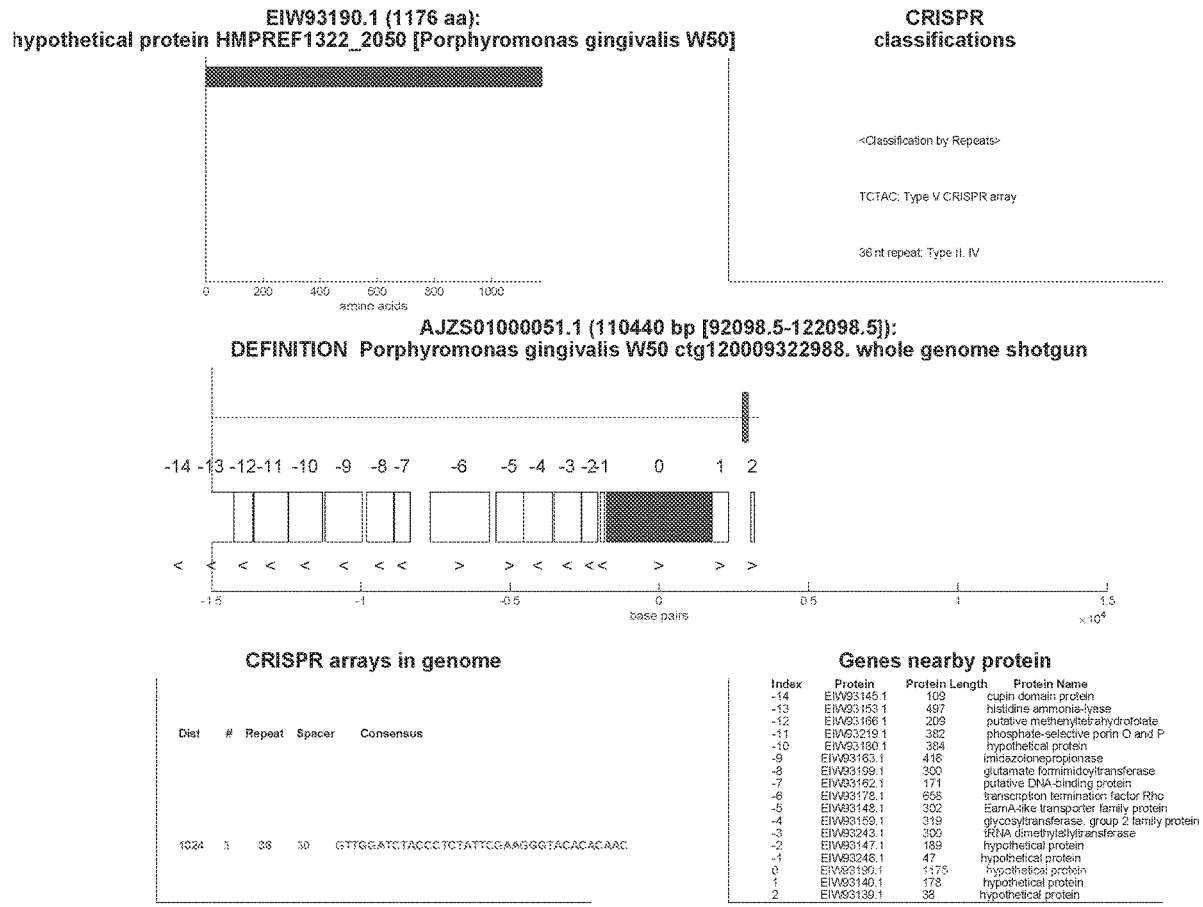
Figure 4F:
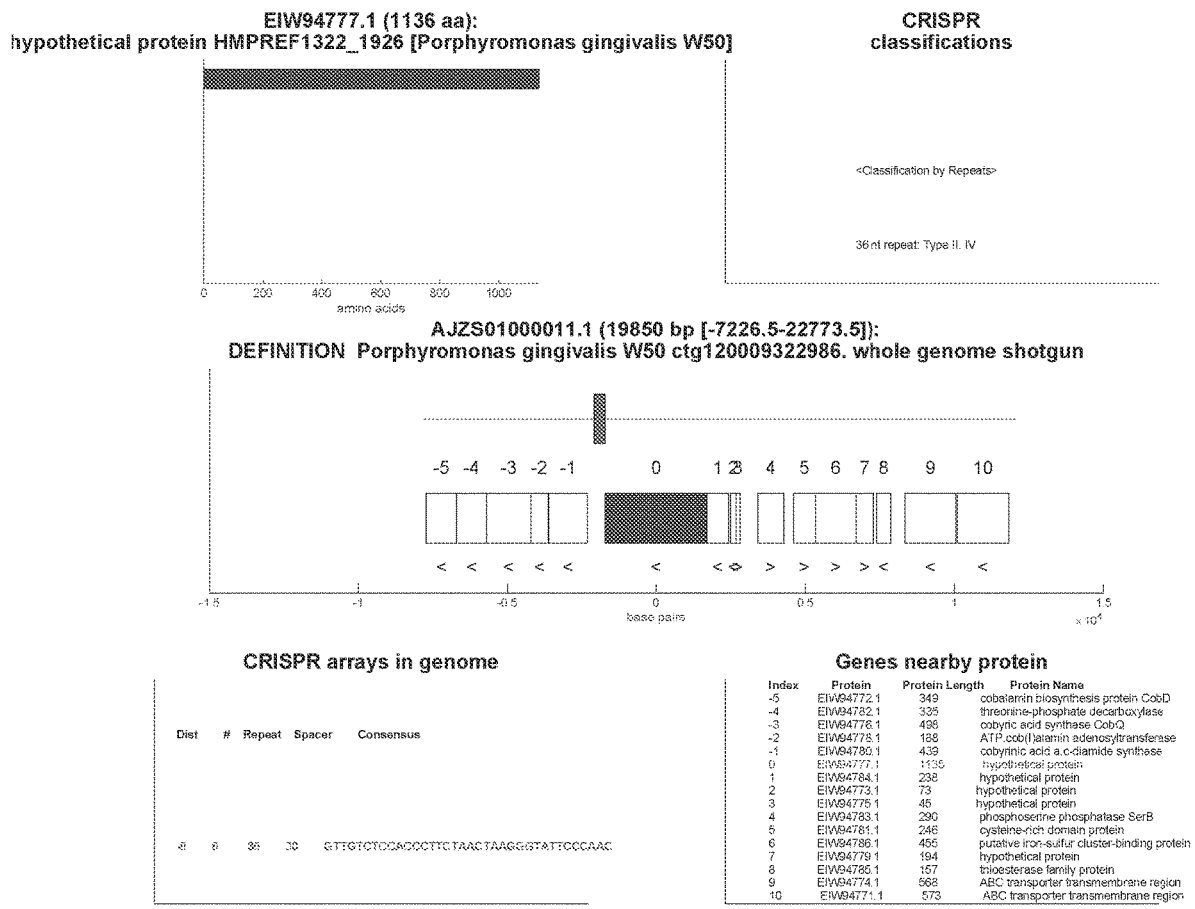
Figure 4G:
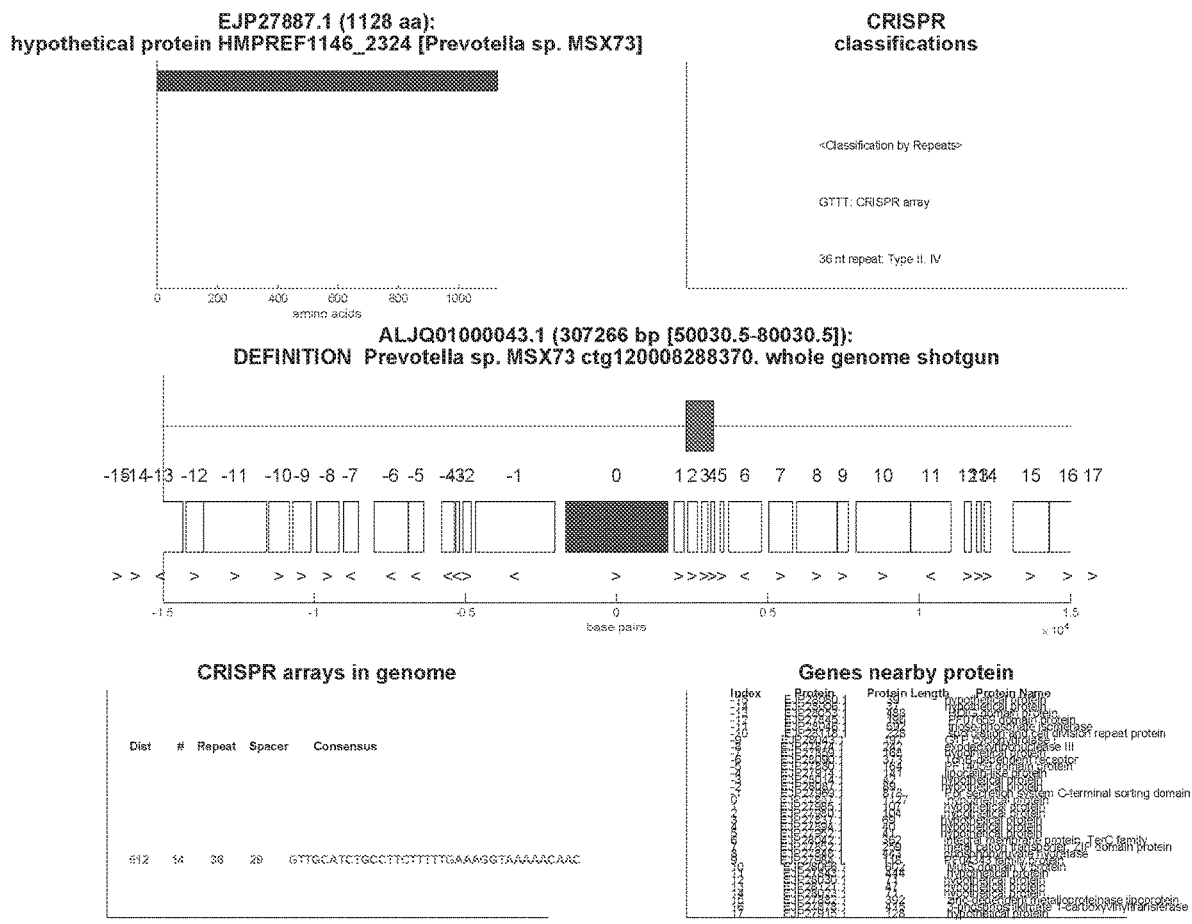
Figure 4I:
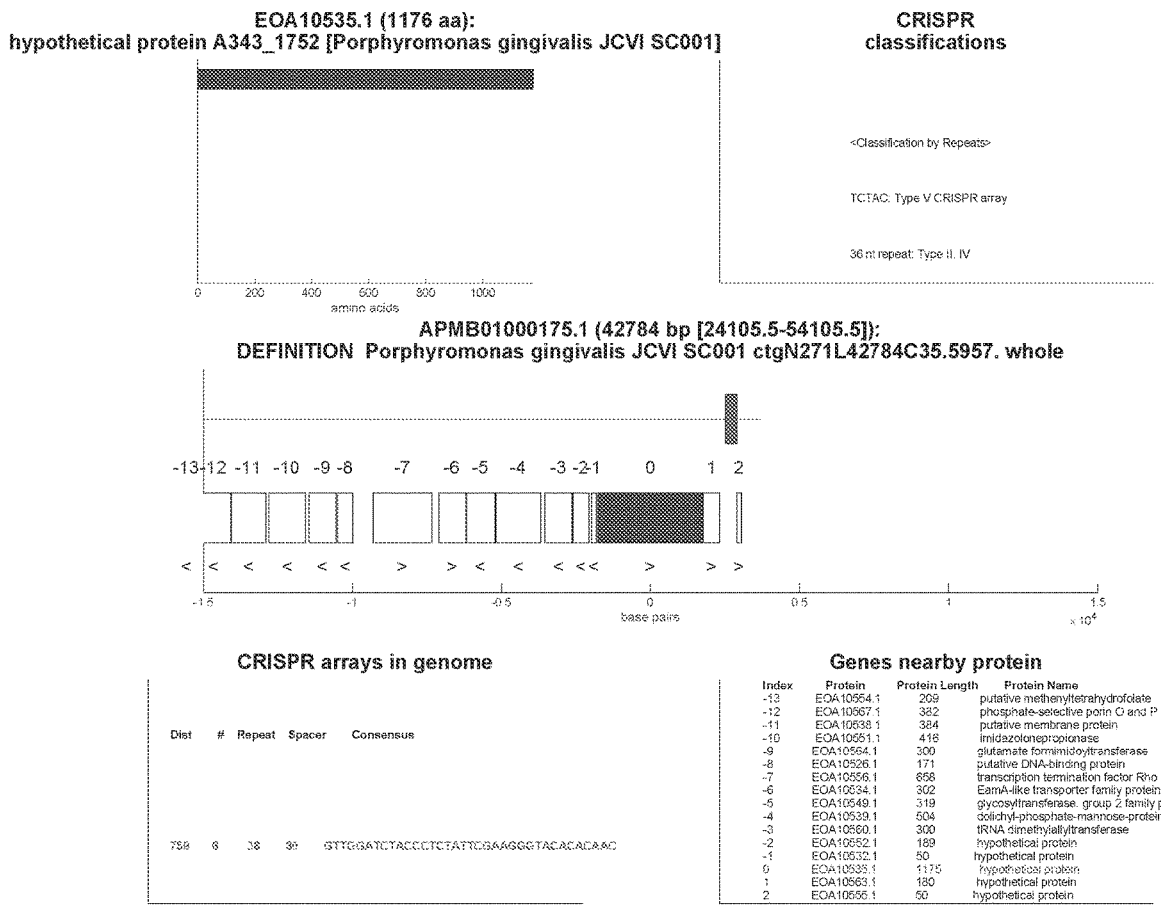
Figure 4K:
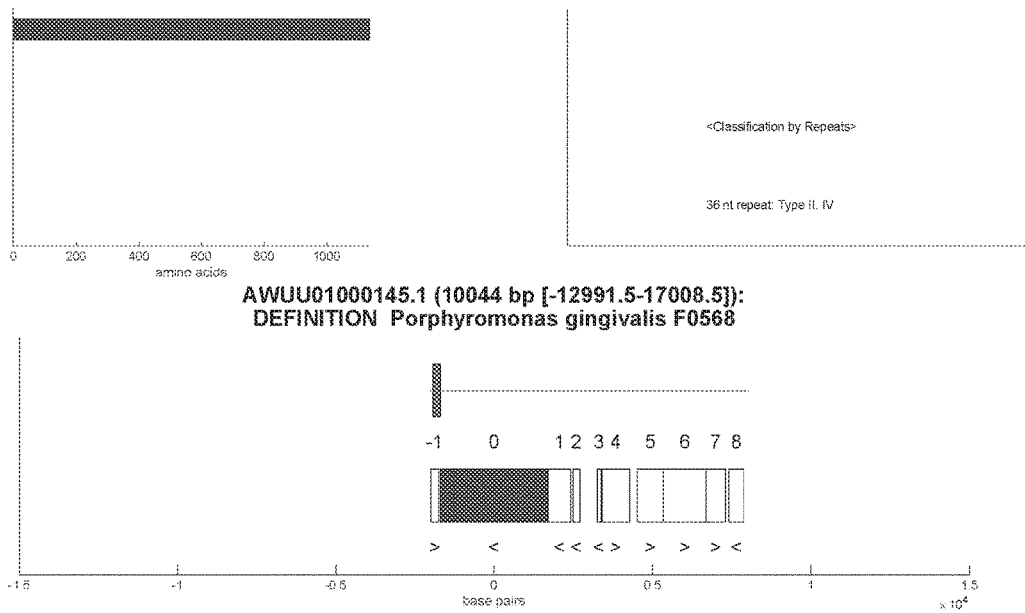
Figure 4N:
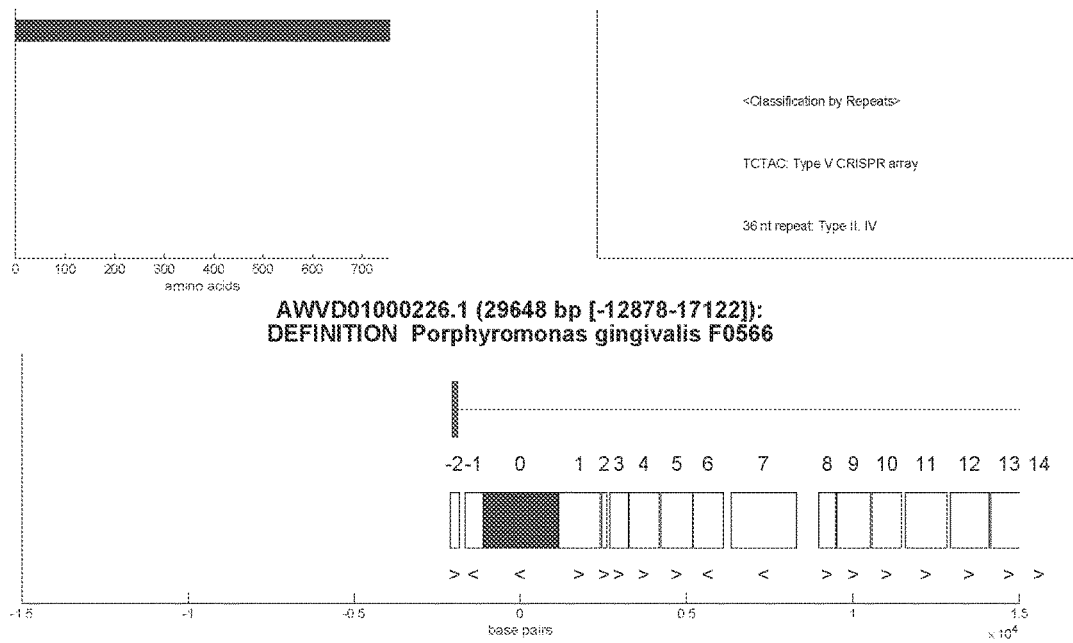
Figure 400:
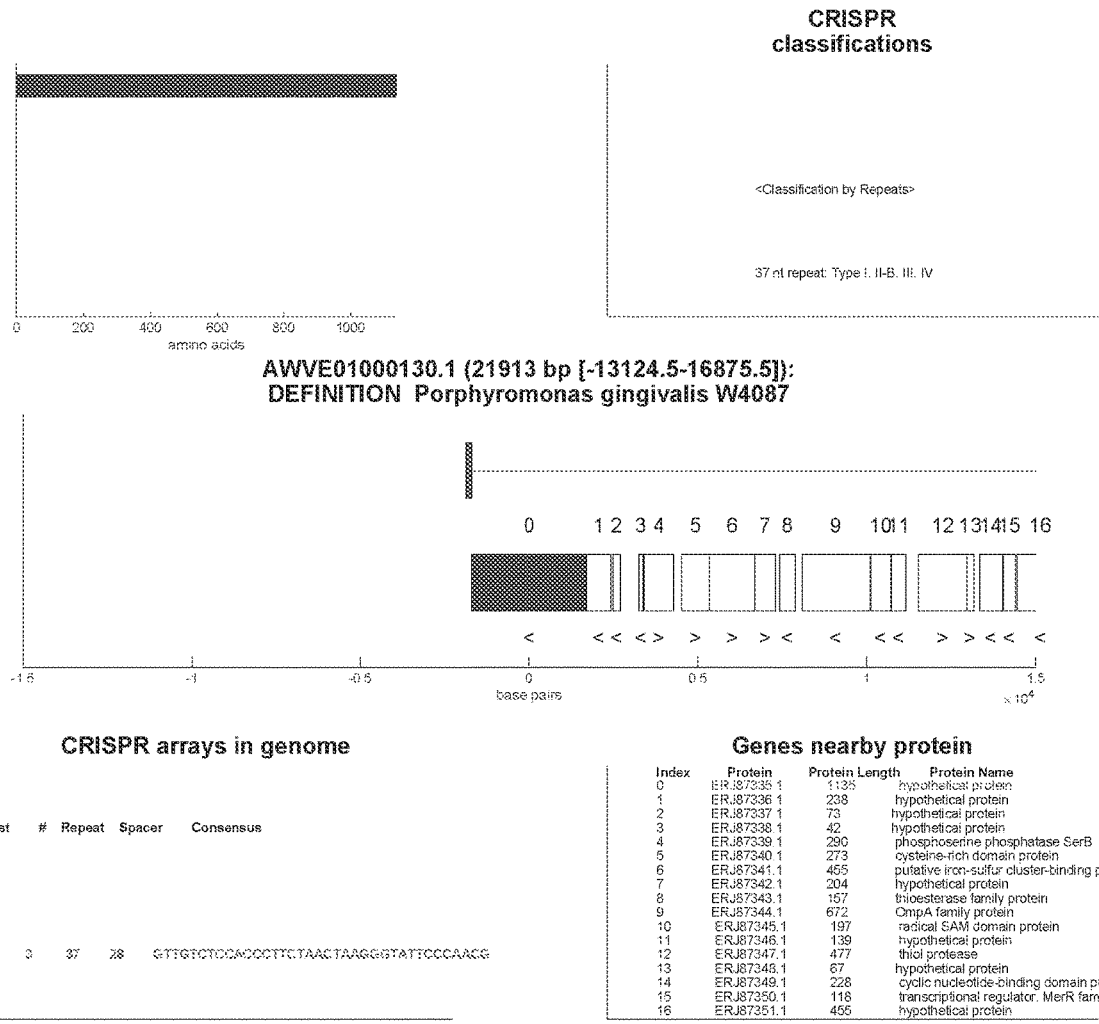
Figure 4P:
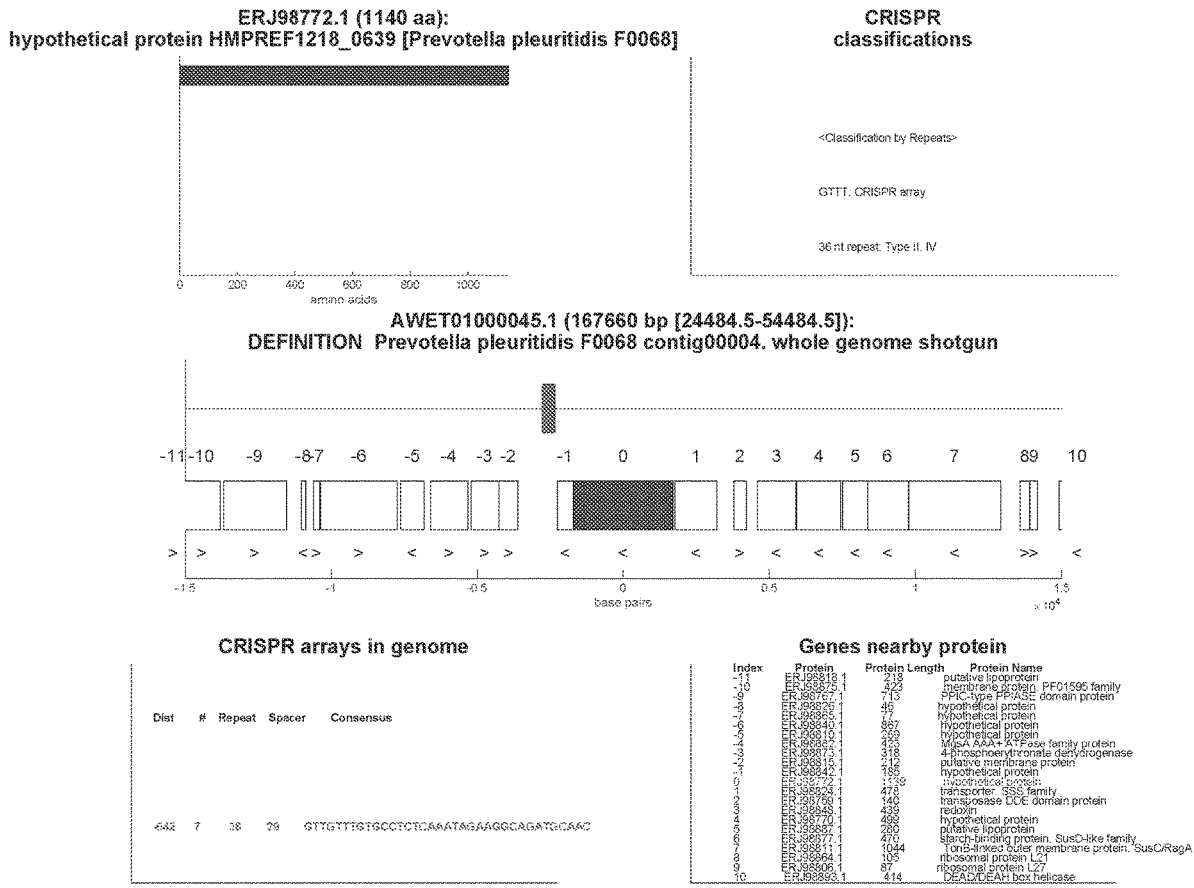
Figure 4Q:
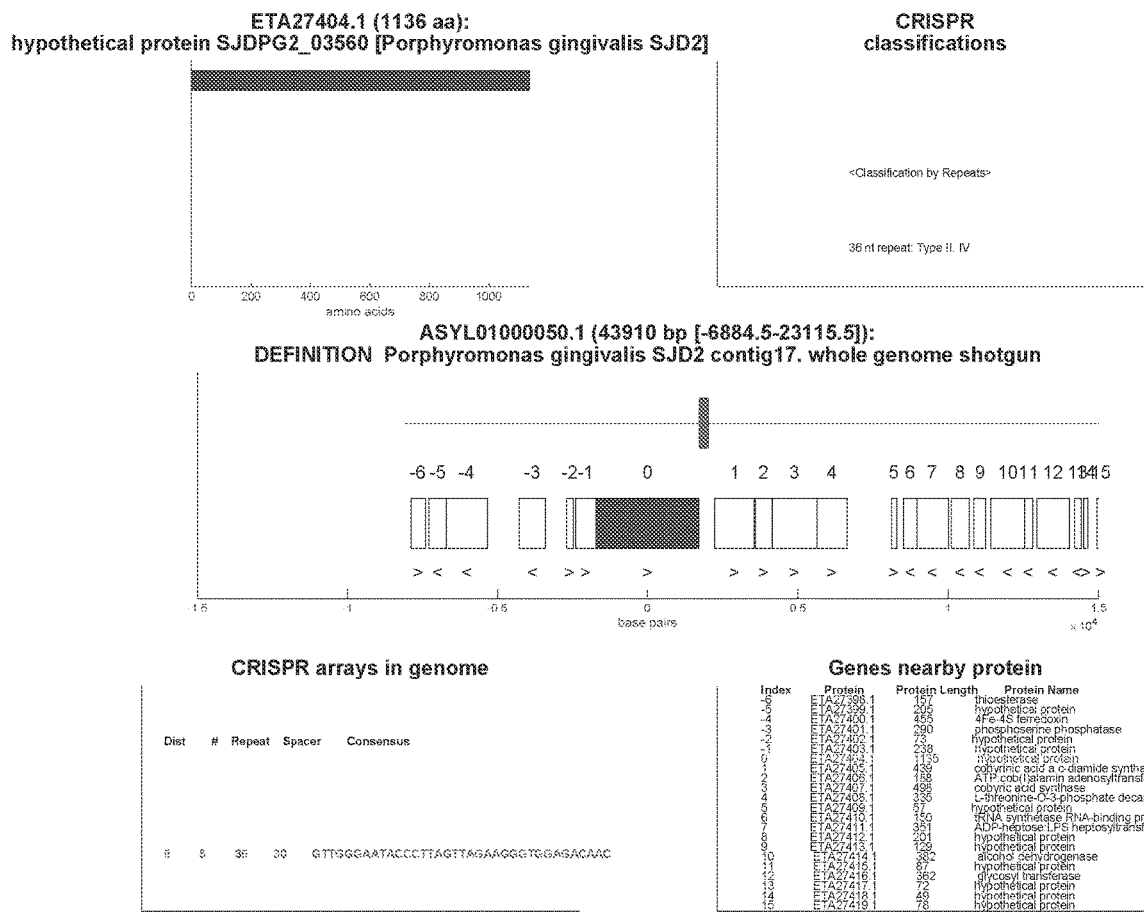
Figure 4R:
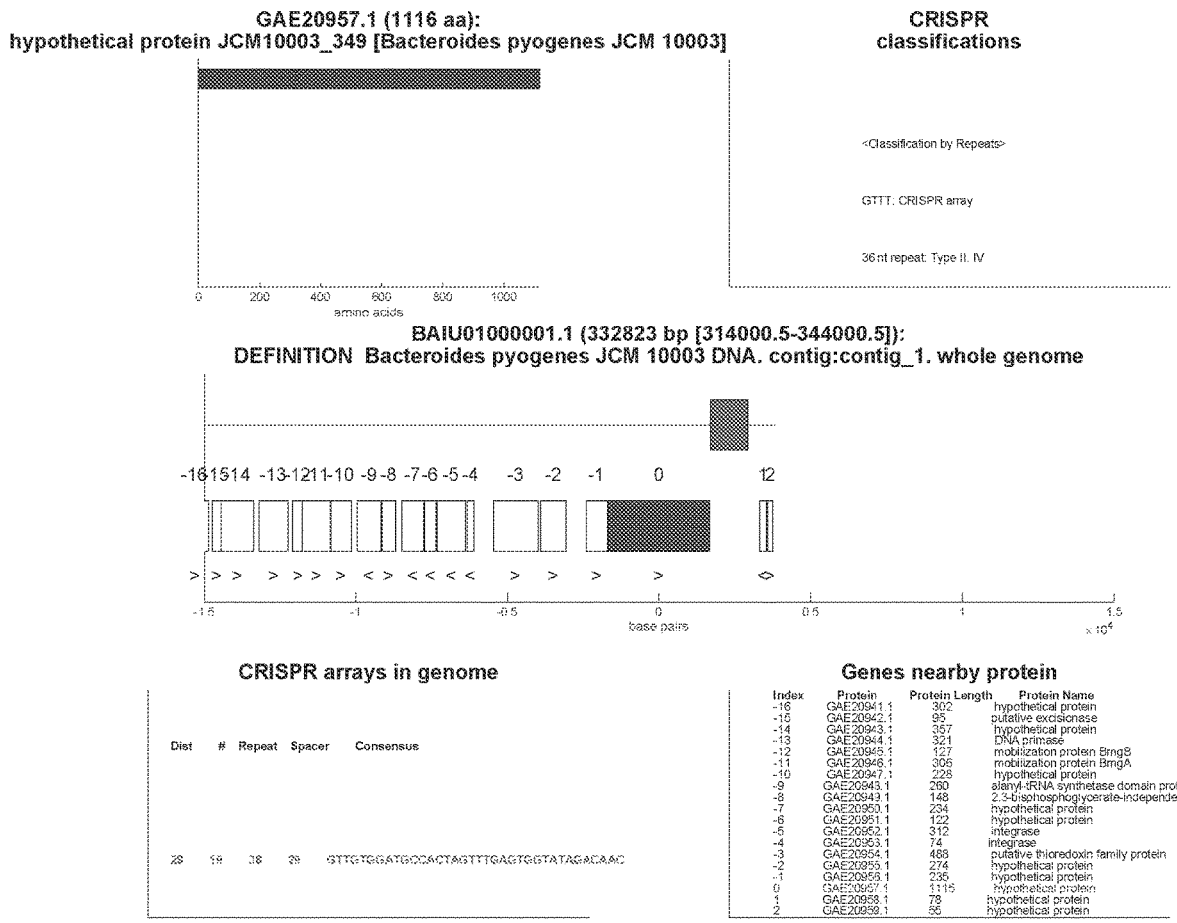
Figure 4S:
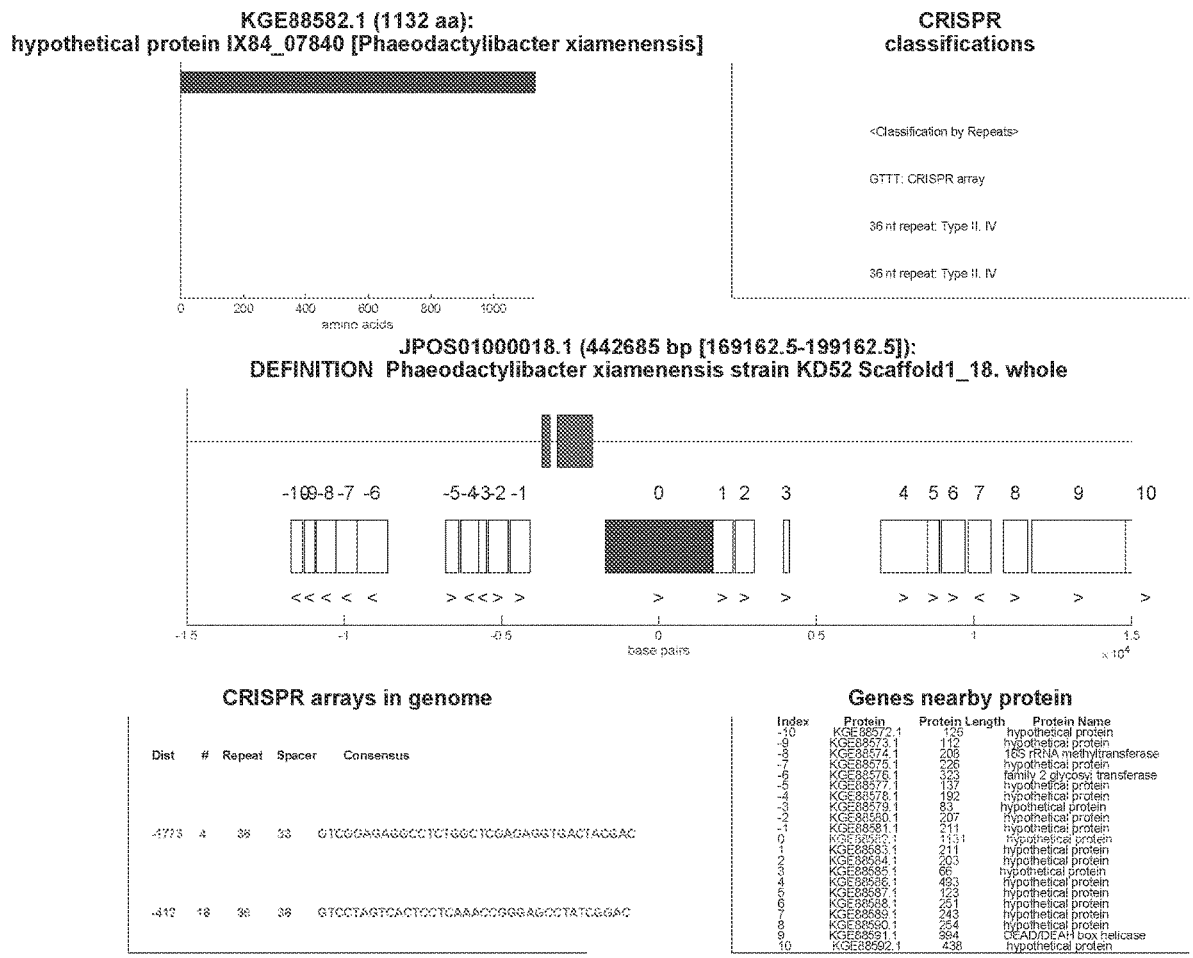
Figure 4T:
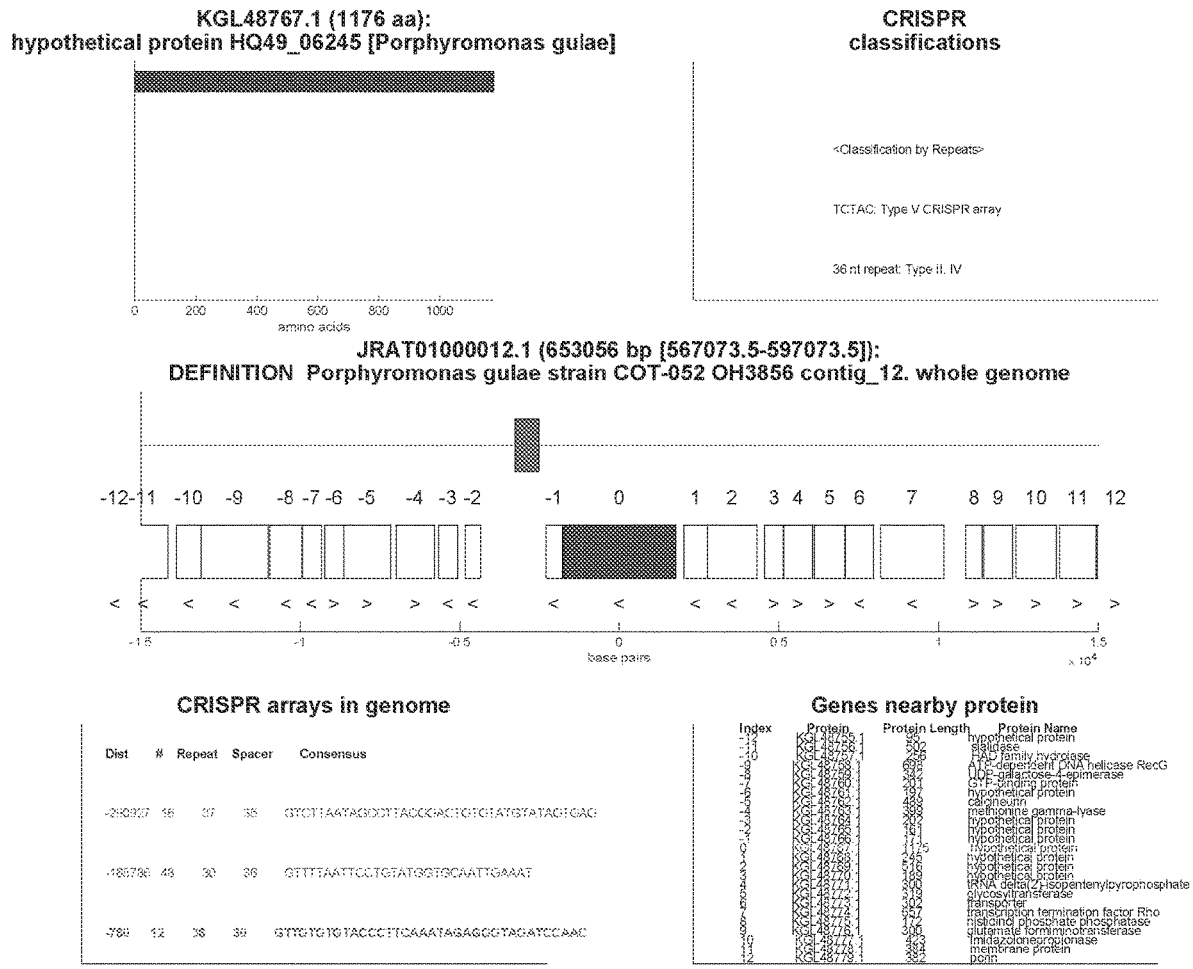
Figure 4U:
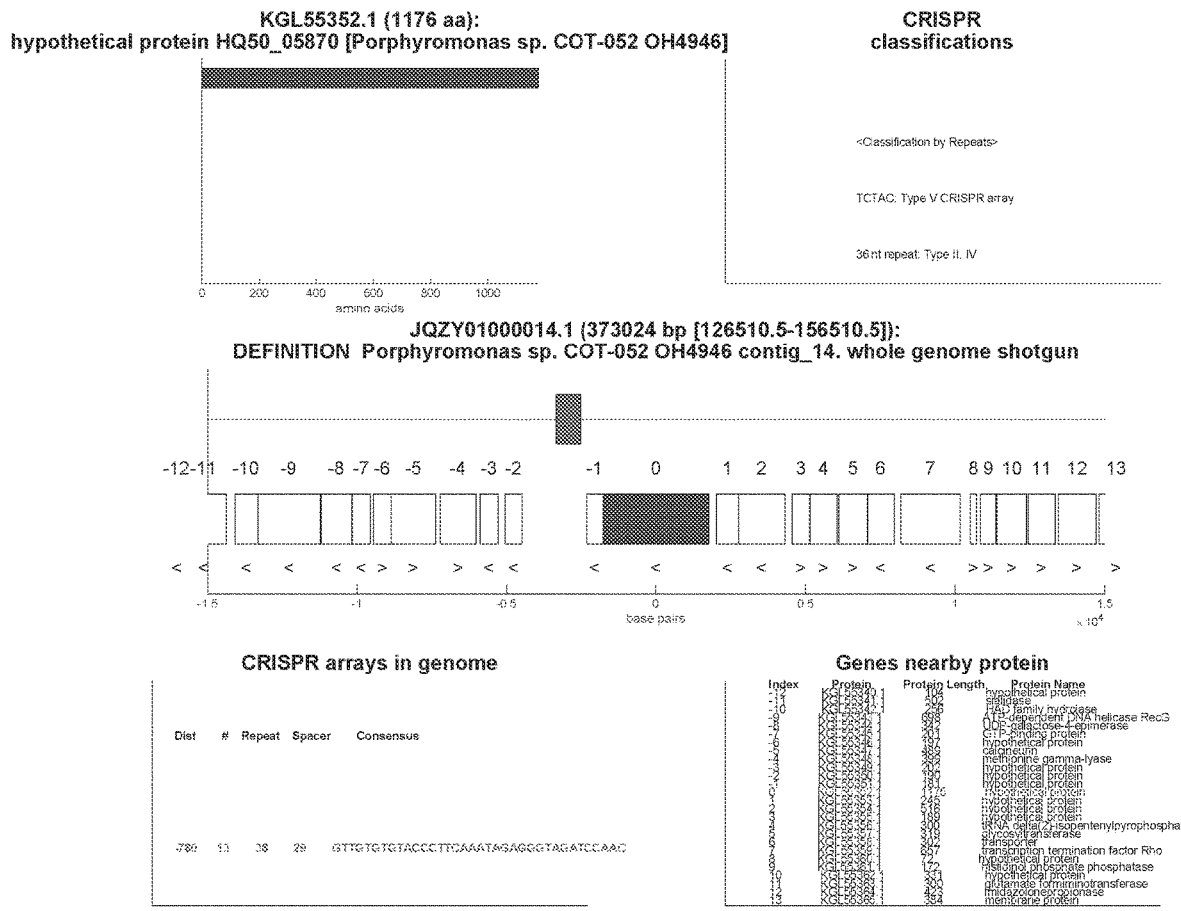
Figure 4V:
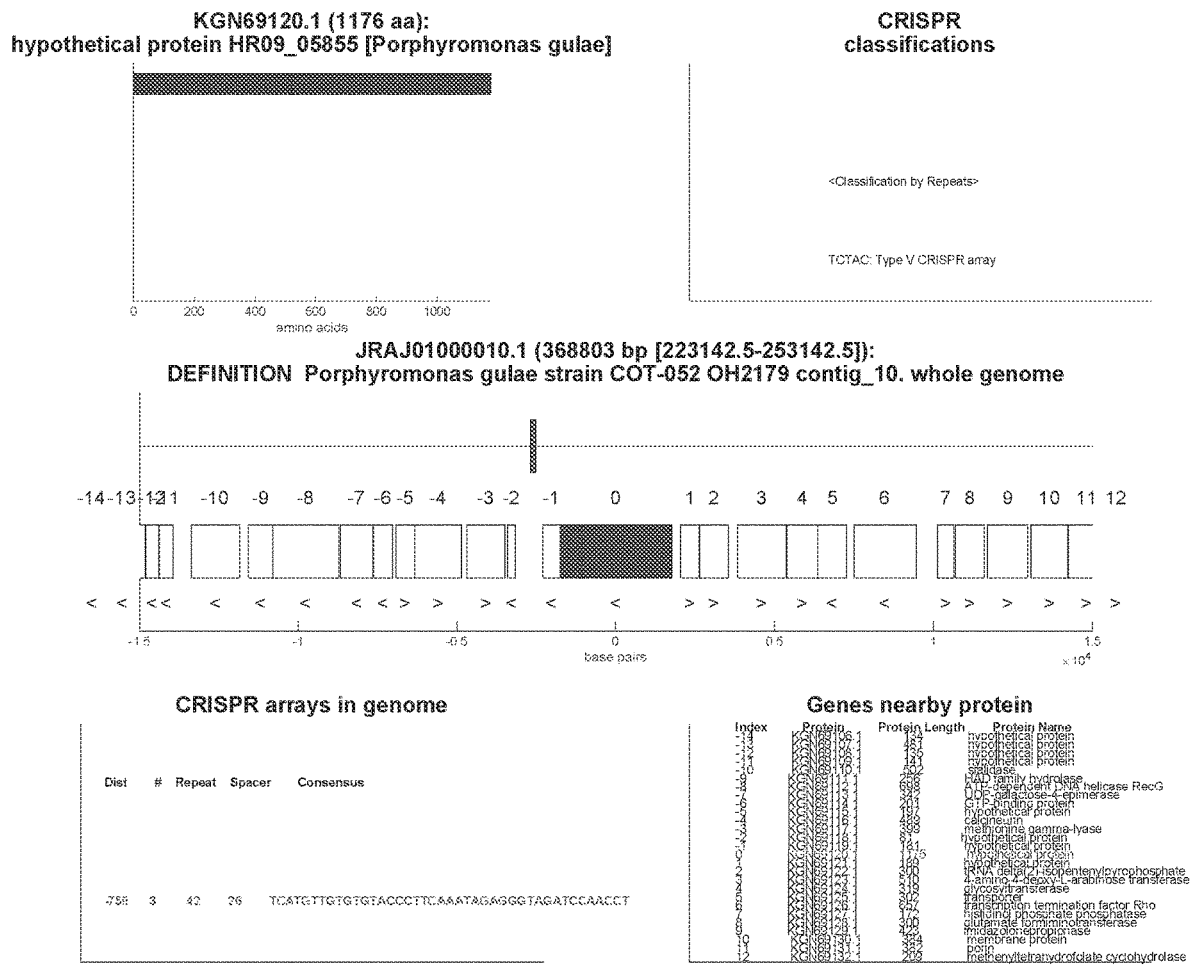
Figure 4W:
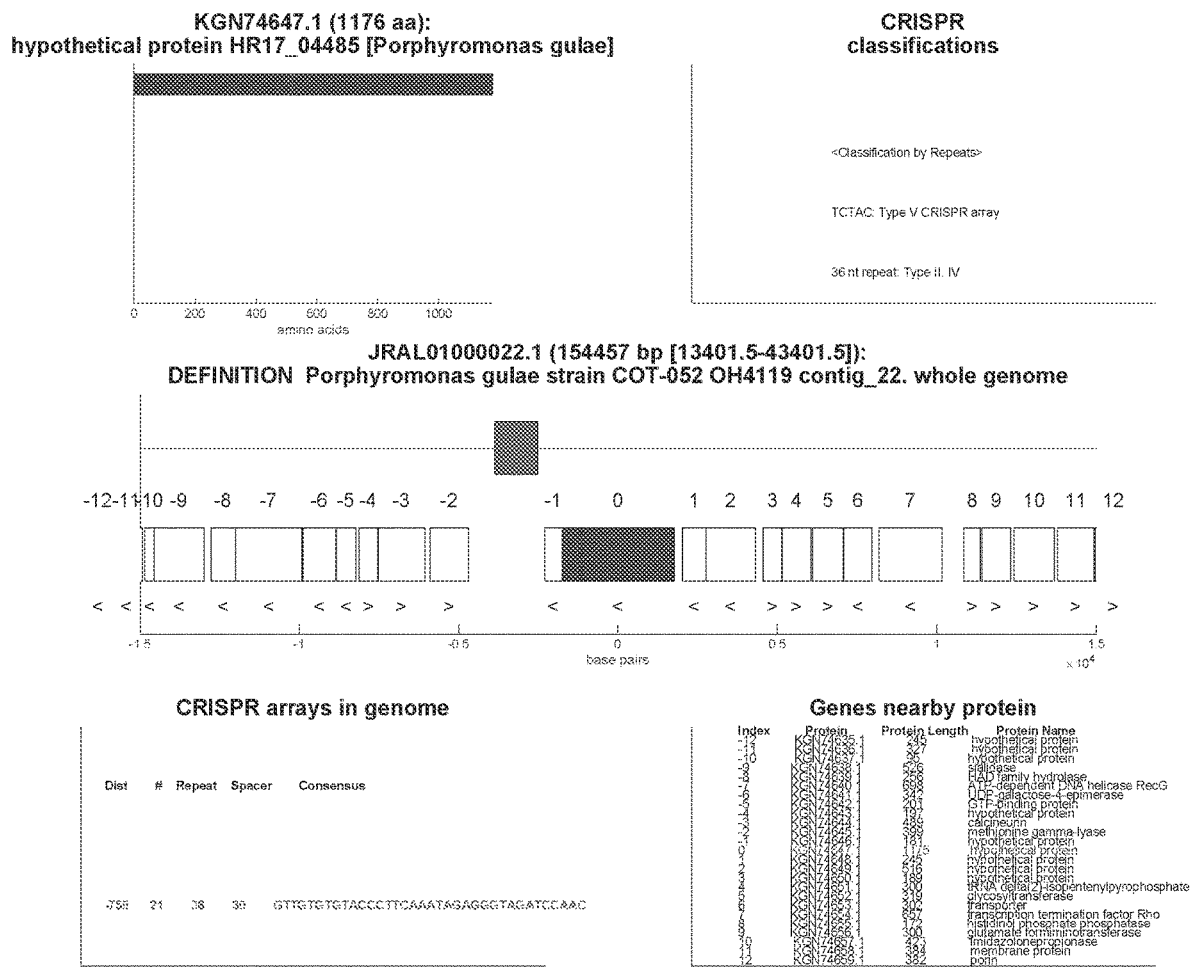
Figure 4X:
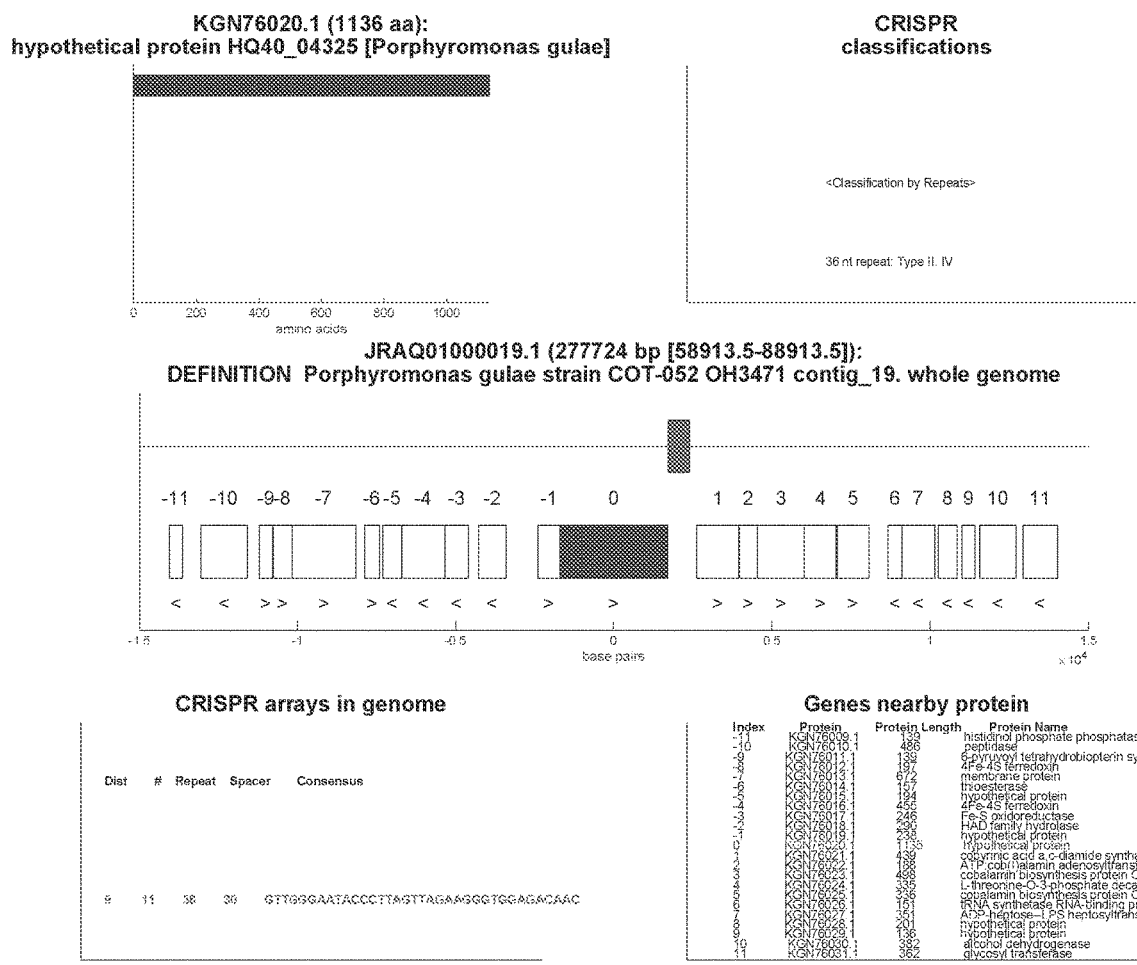
Figure 4Y:
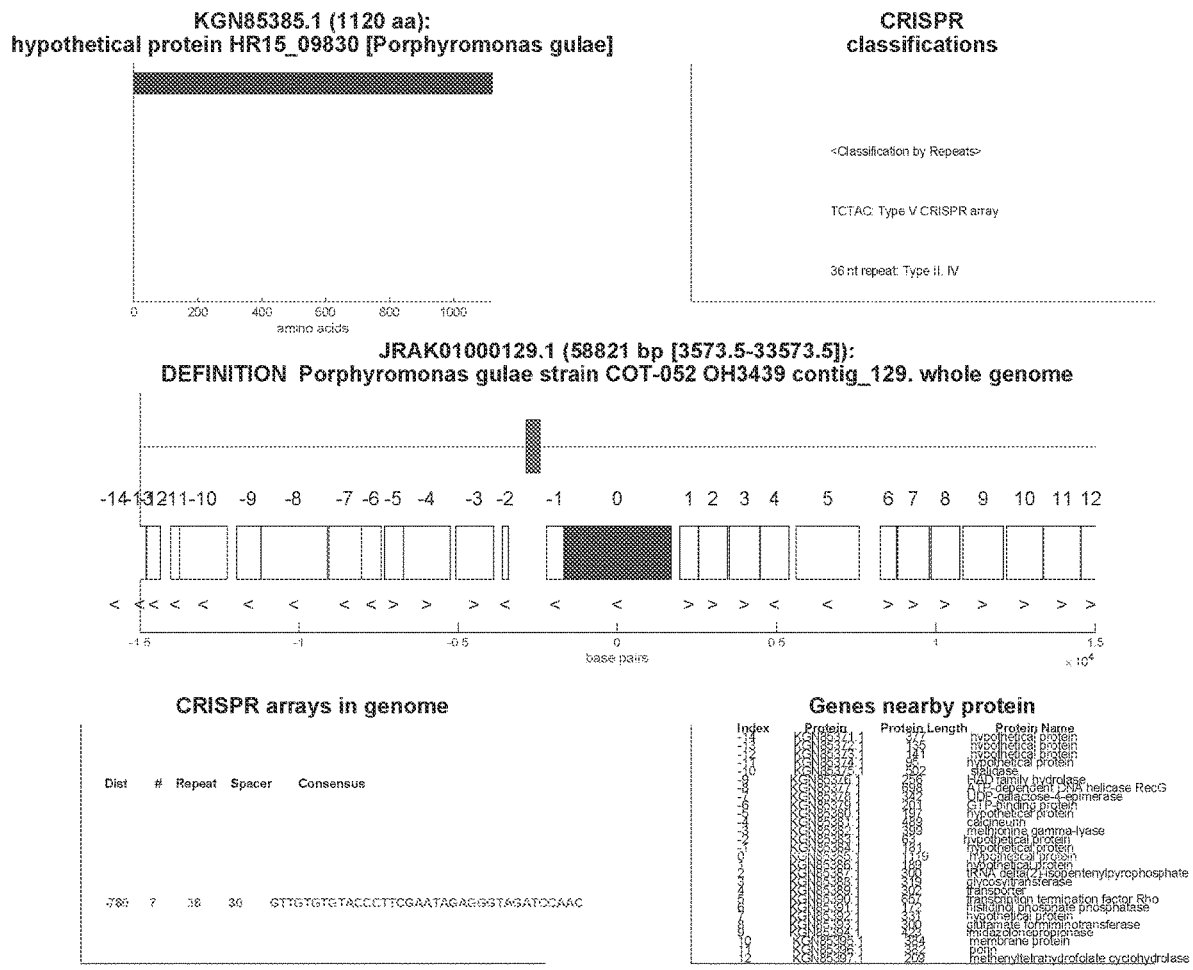
Figure 4Z:
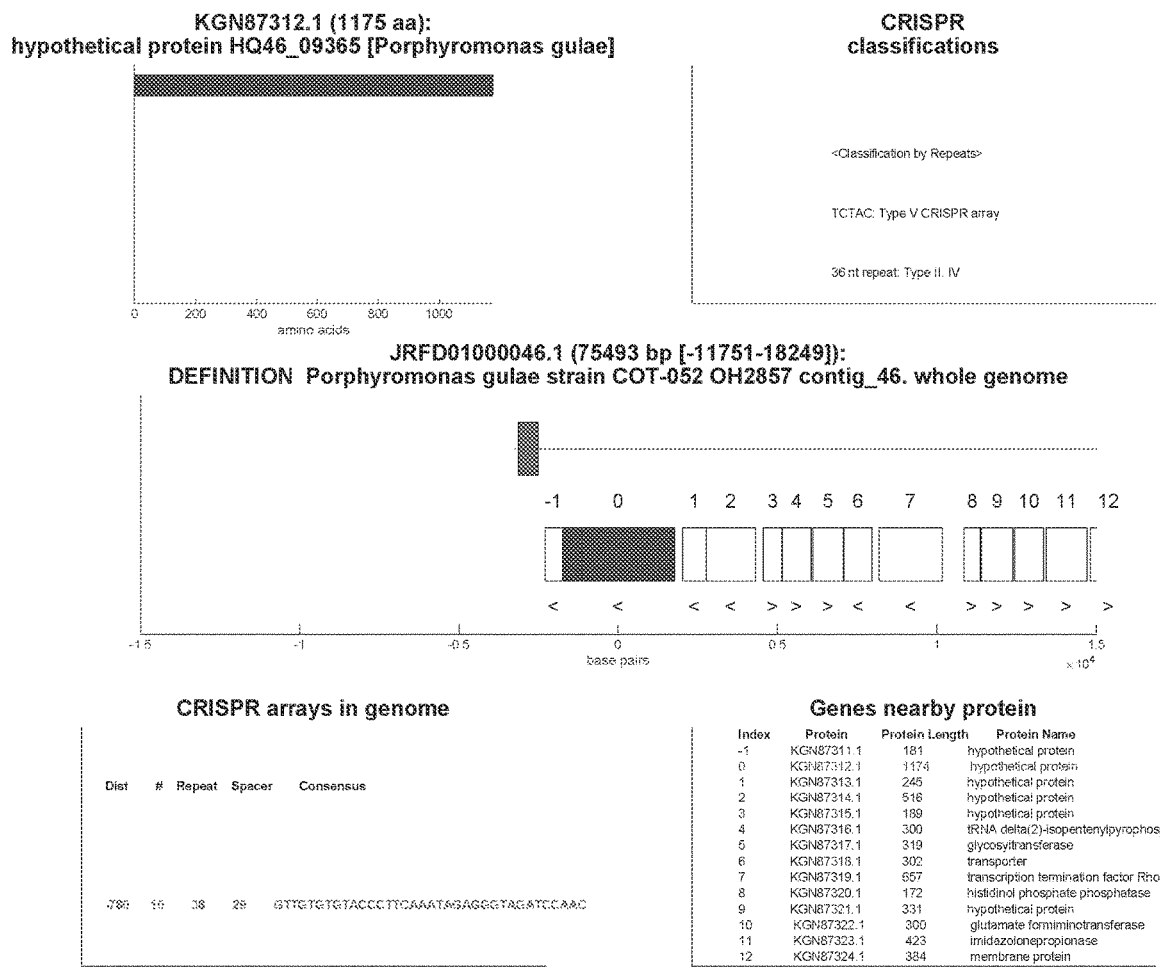
Figure 8:
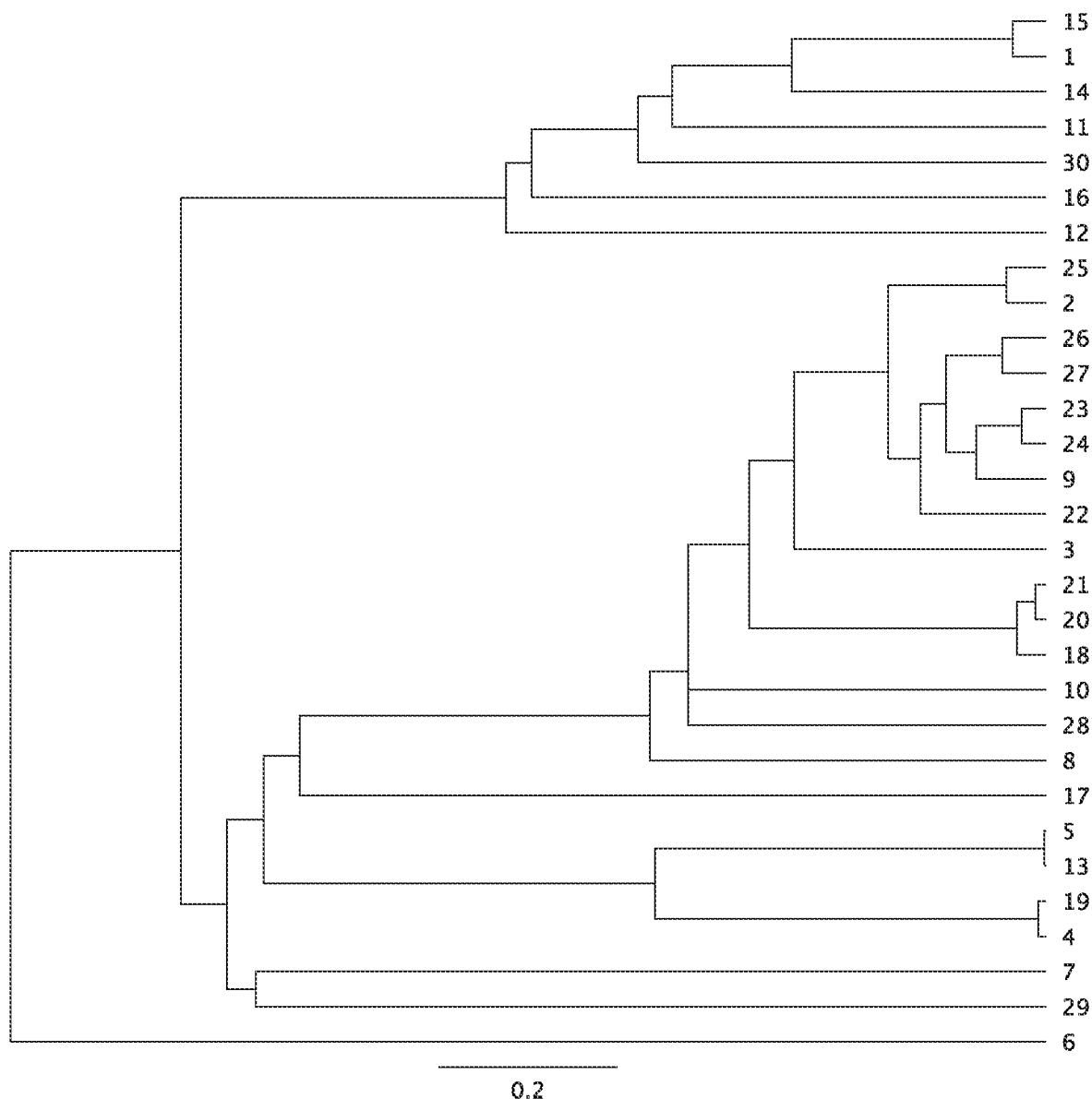
FIG. 8 shows a phylogenic tree of select subset of unique Group 29 proteins.
Figure 9:
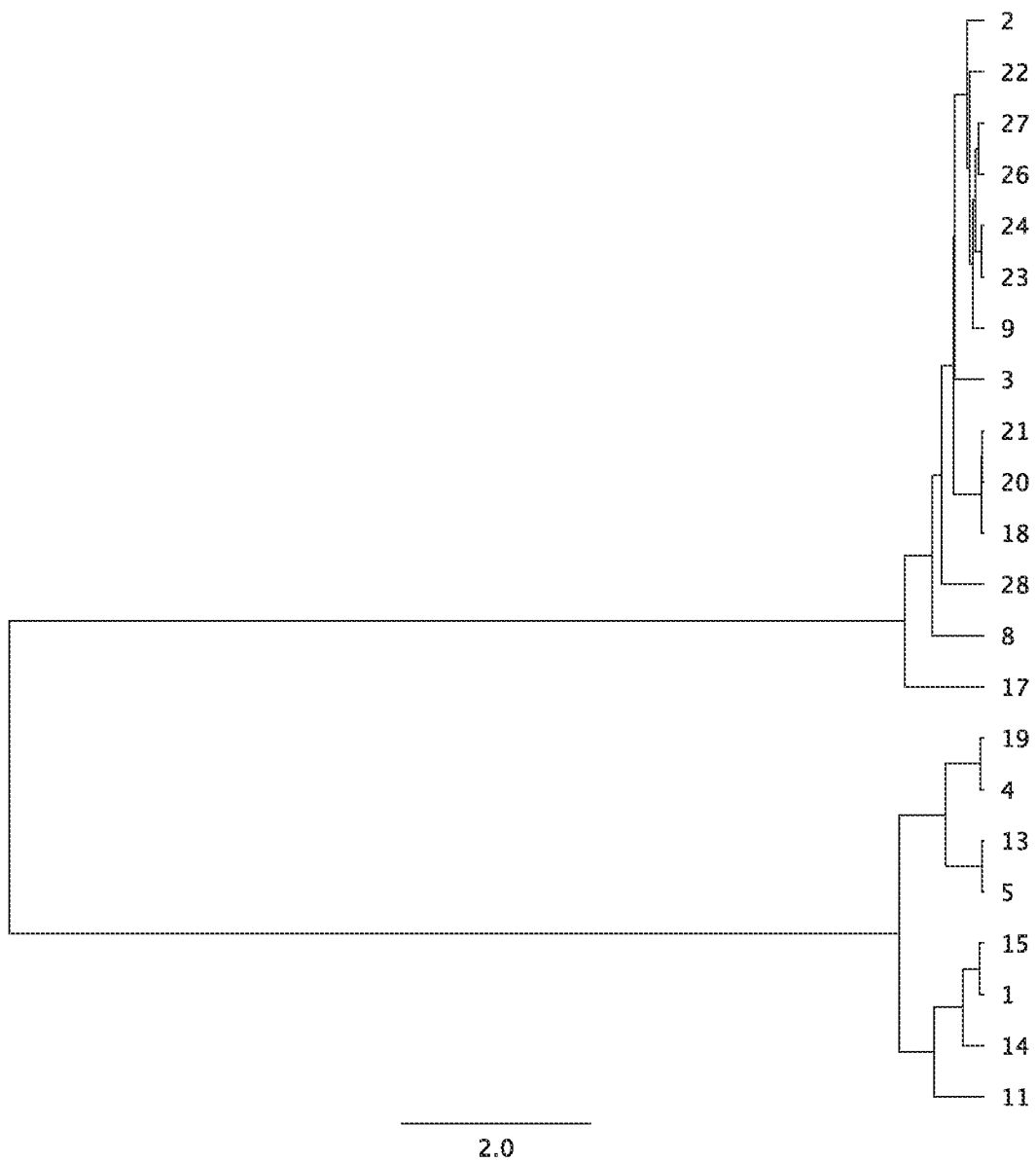
FIG. 9 shows a phylogenic tree of accessory small proteins to select subset of unique Group 29 proteins.
Figure 10:
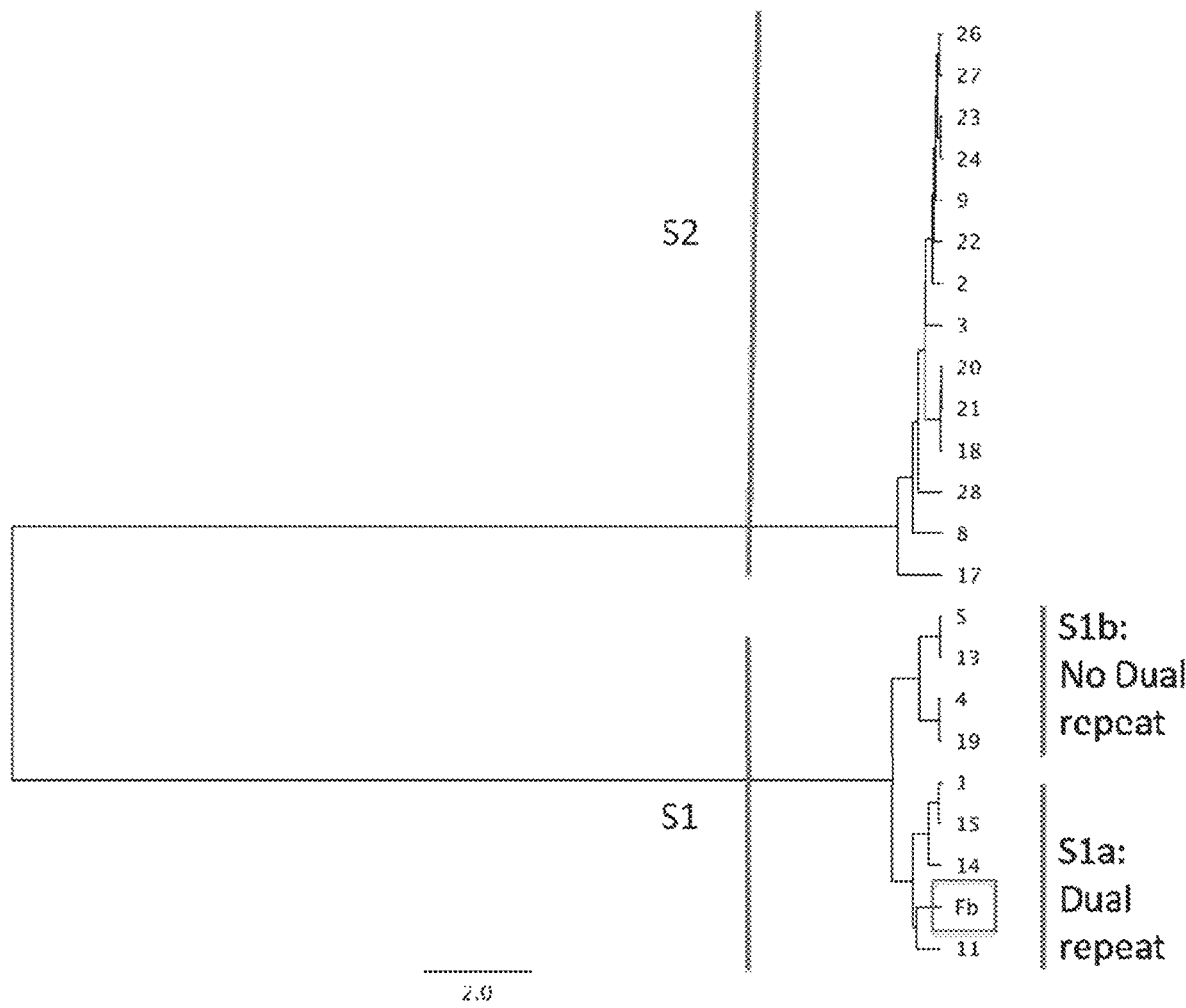
FIG. 10 shows a phylogenetic tree of small proteins indicating that *Flavobacterium branchiophilum* (Fb) is similar to other small proteins associated with loci that have dual direct repeats.
Figure 11:
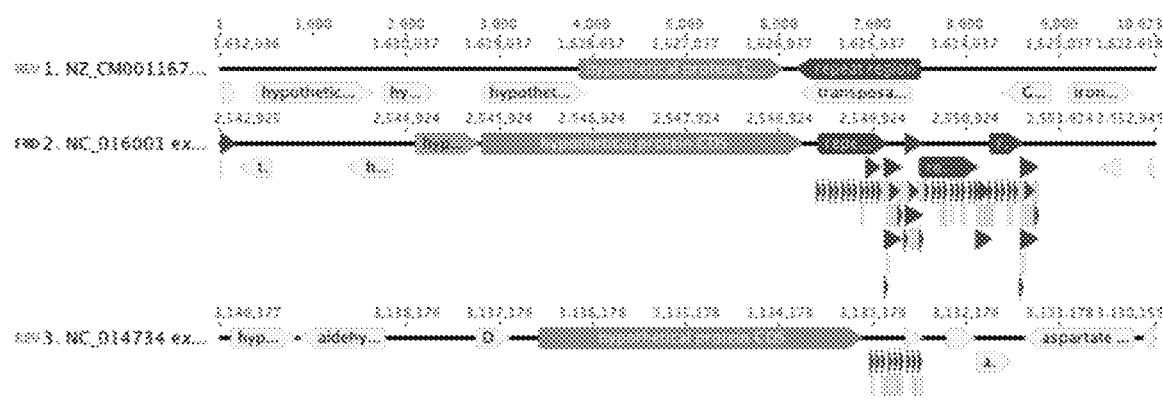
FIG. 11 depicts the Fb and *Paludibacter propionicigenes* (Pp) gene loci.
Figure 12:
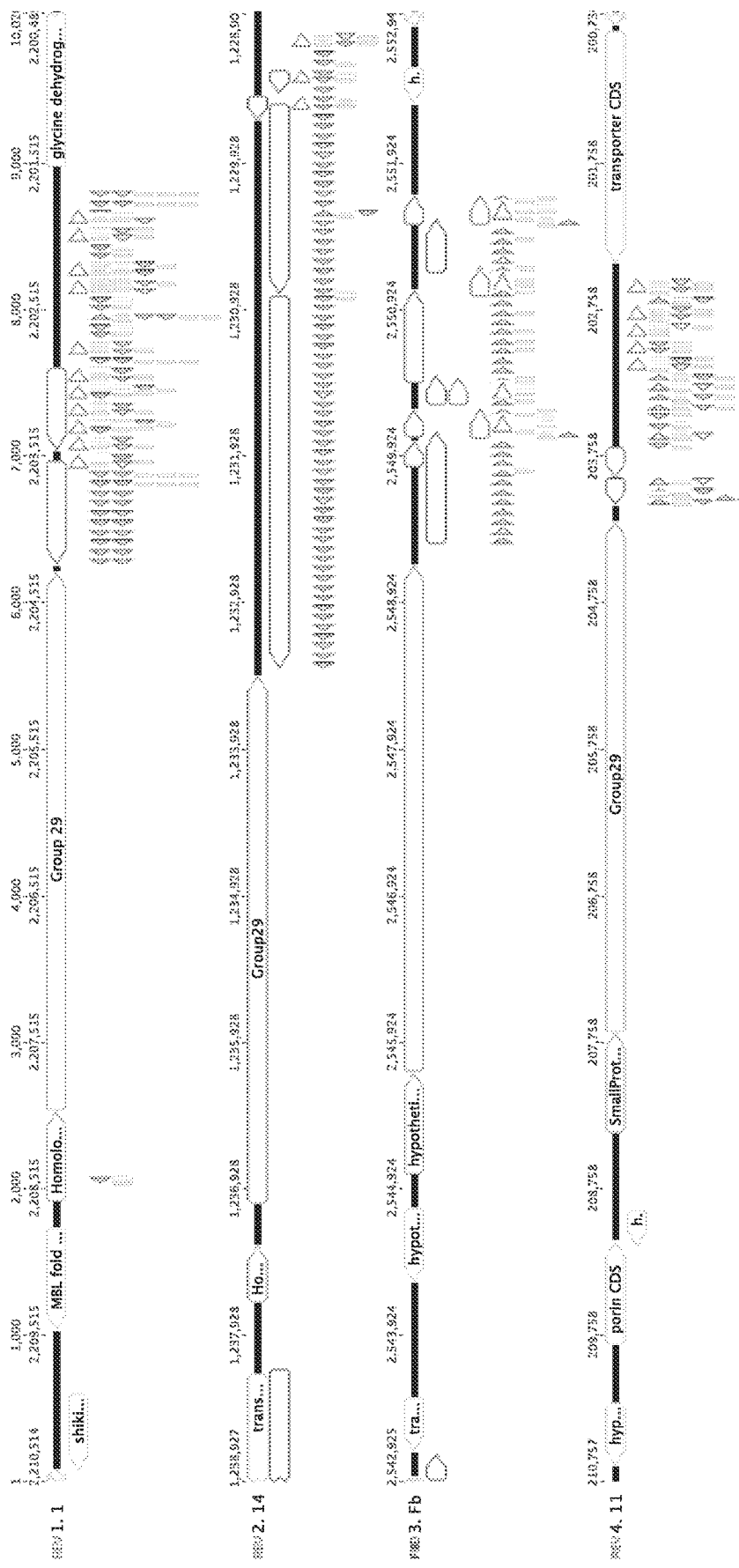
FIG. 12 shows a comparison of gene loci indicating that small Sla proteins are associated with CRISPR loci with dual repeats.
Figure 13A:
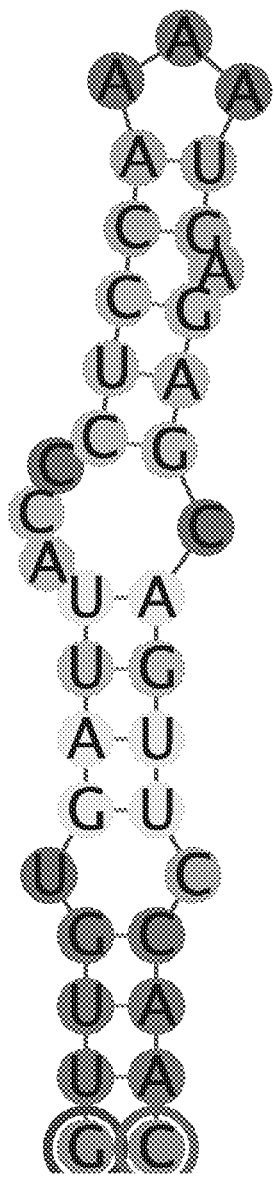
FIGS. 13A-13F show predicted RNA folding of direct repeats of subset of Group 29 proteins selected for uniqueness. Includes putative dual direct repeats for proteins 1, 11 and 14, corresponding to Group 29 proteins with accessory small protein Sla. (SEQ ID Nos. 609 through 639)
Figure 13B:
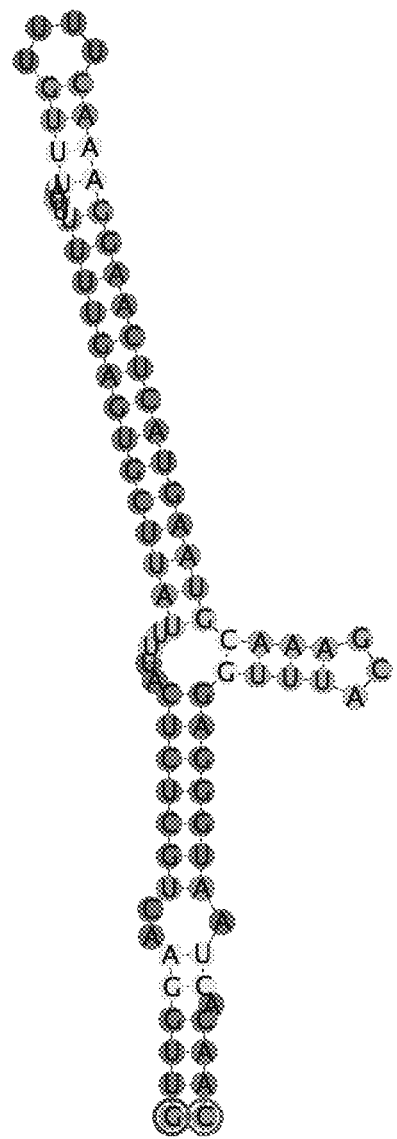
Figure 13C:
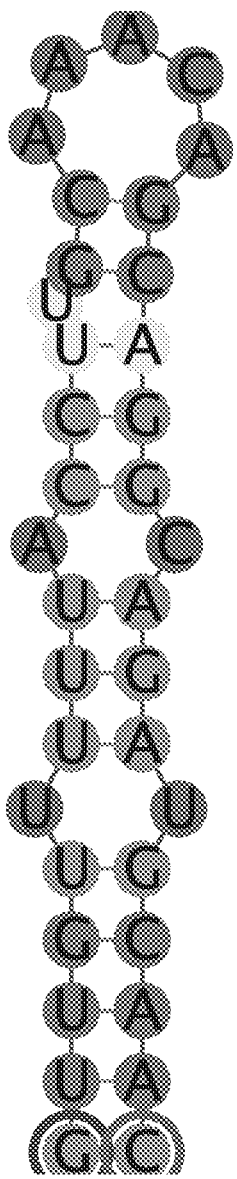
Figure 13D:
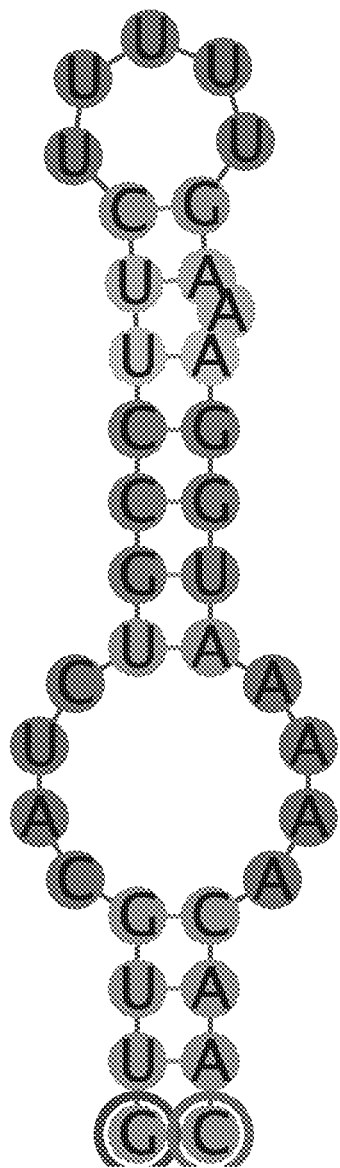
Figure 13E:
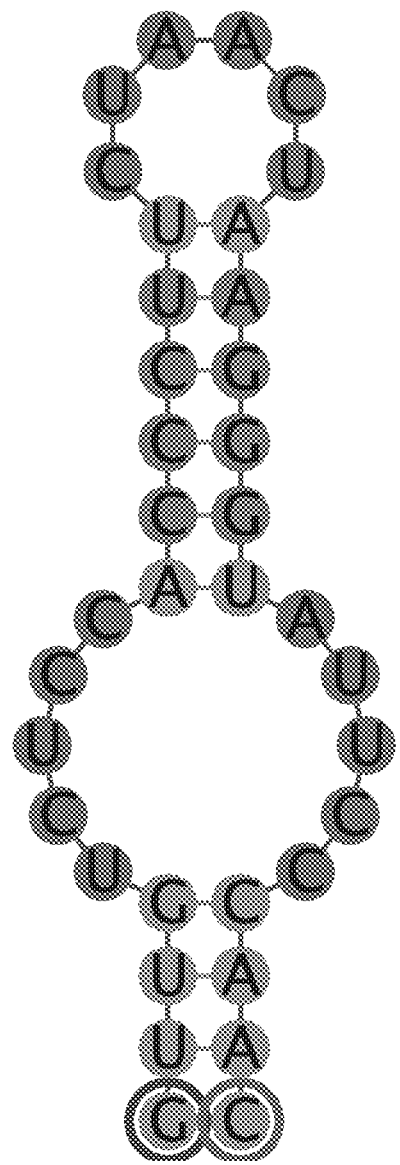
Figure 13F:
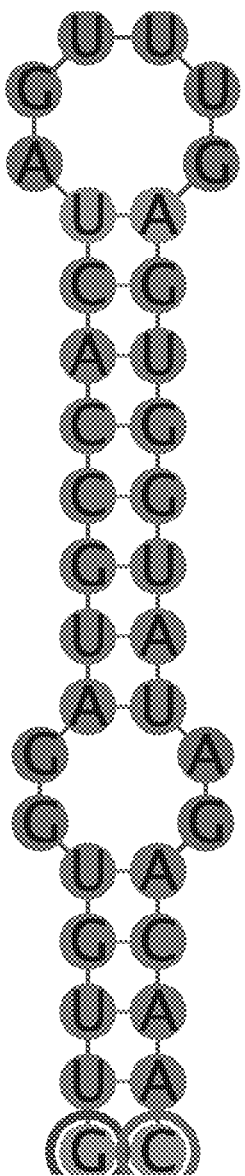
Figure 13G:
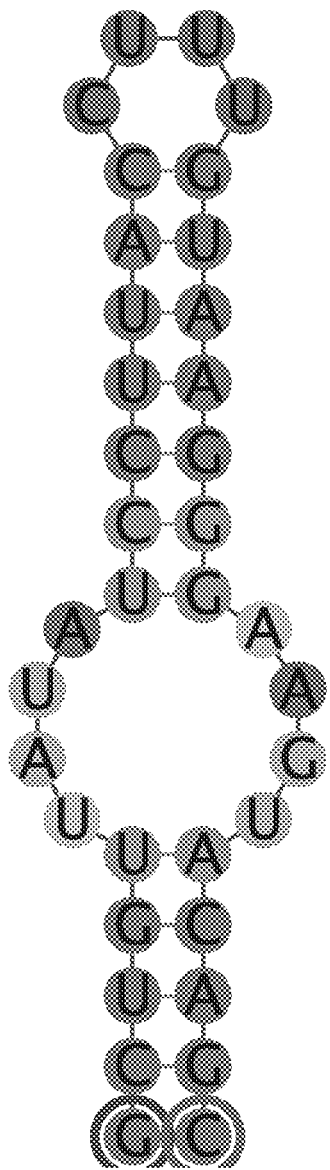
Figure 13H:
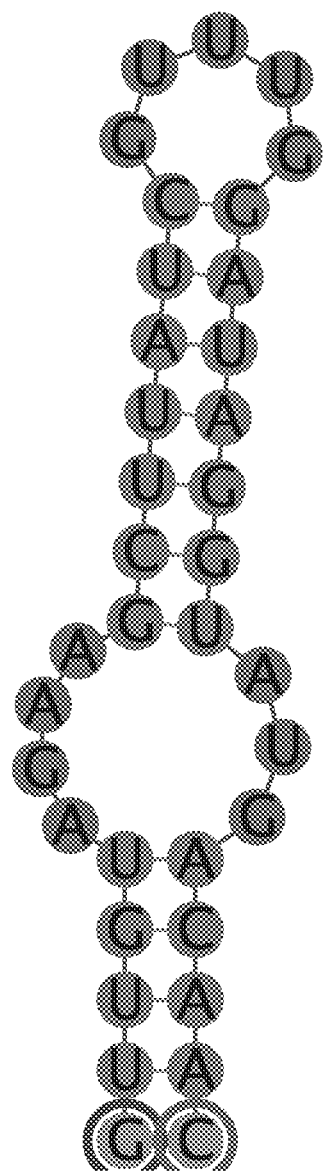
Figure 13I:
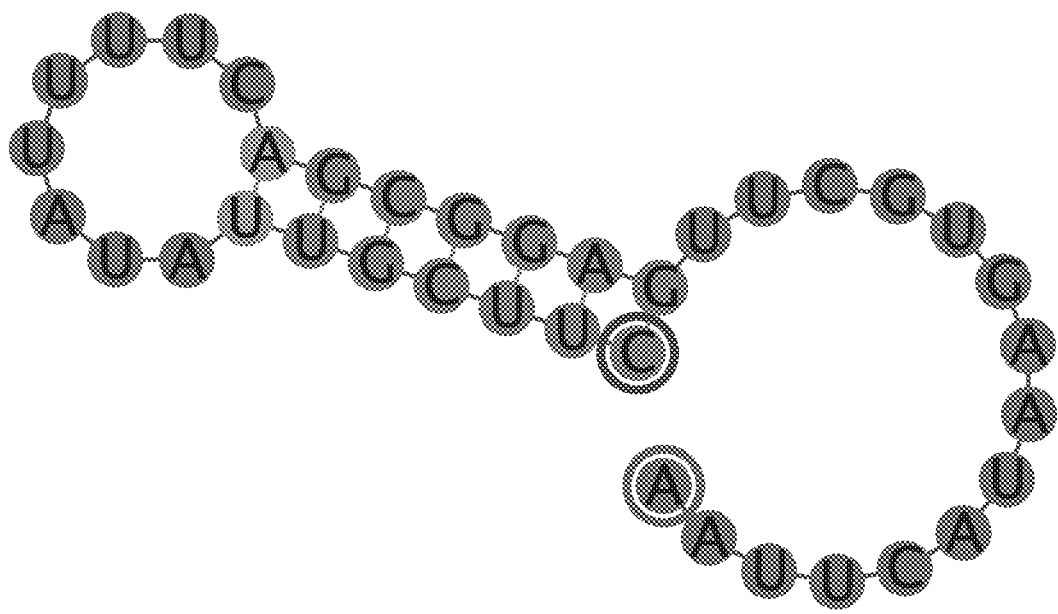
Figure 13J:
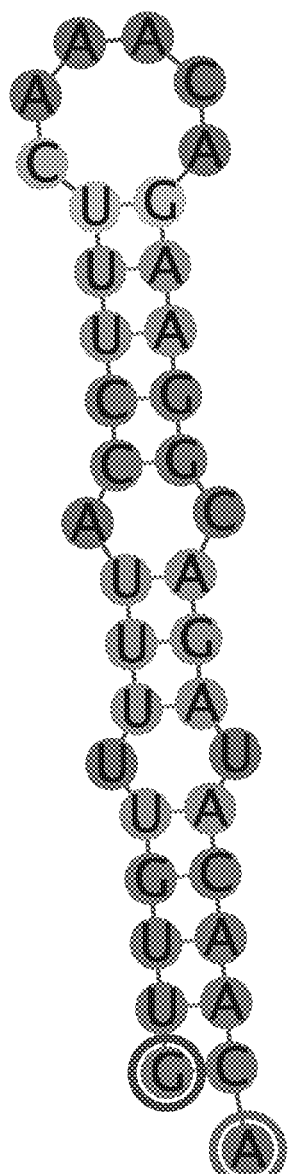
Figure 13K:
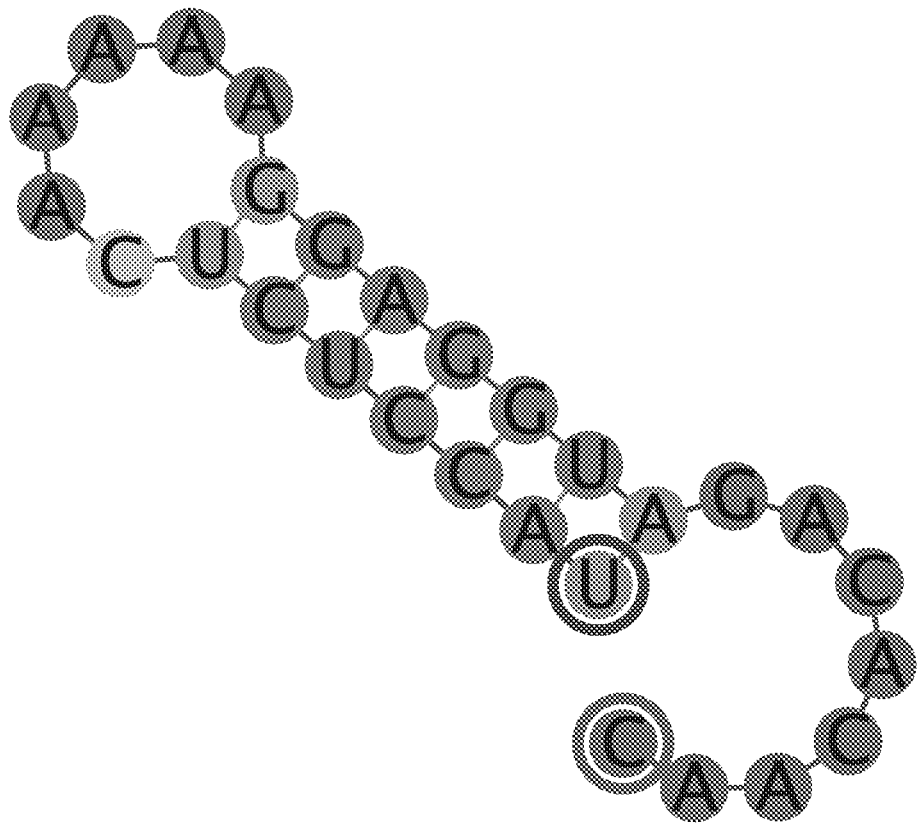
Figure 13L:
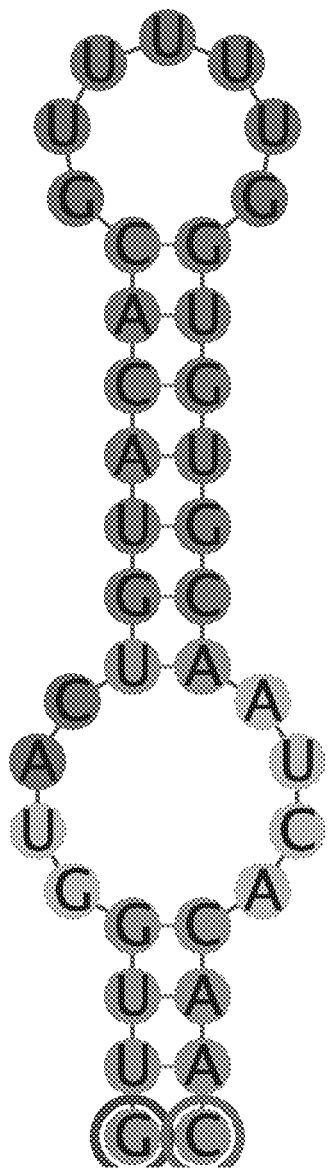
Figure 13M:
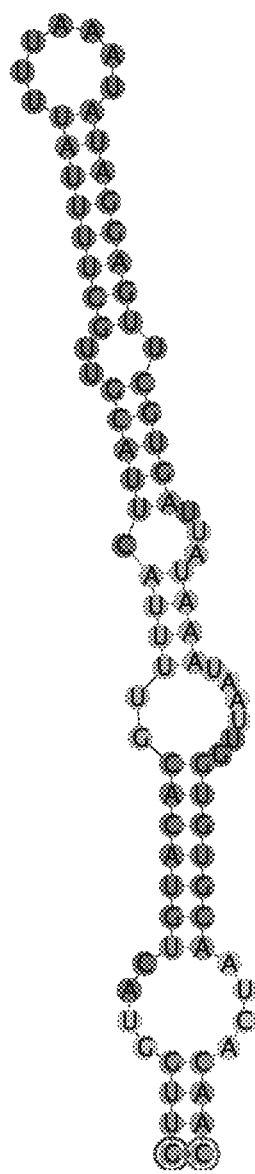
Figure 13N:
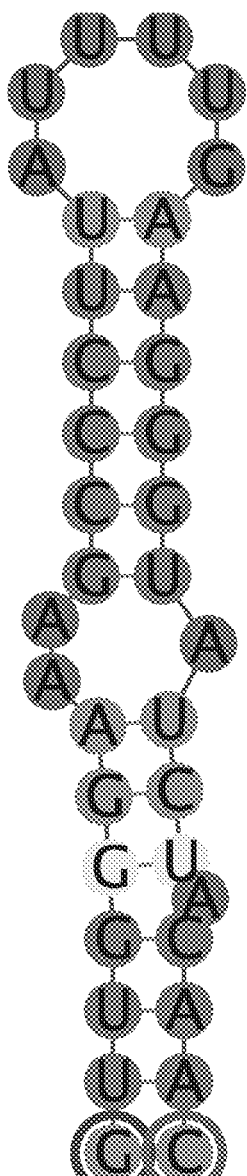
Figure 13O:
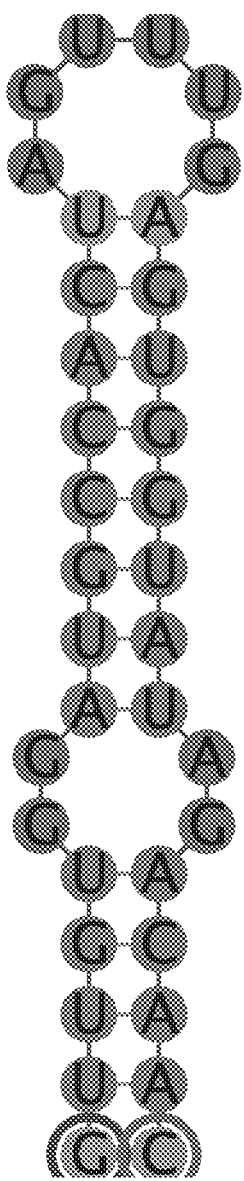
Figure 13P:
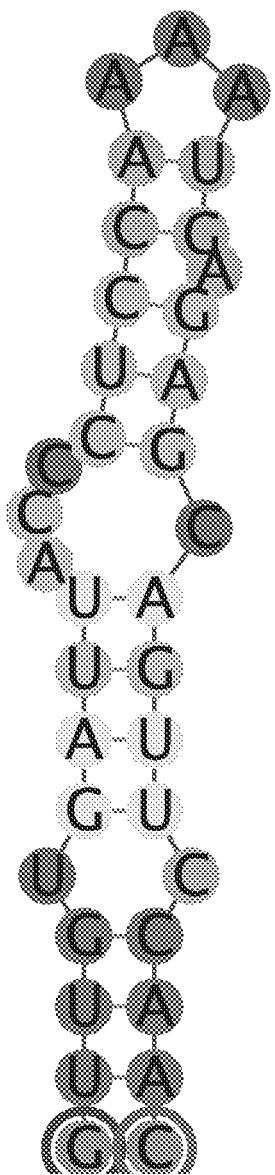
Figure 13Q:
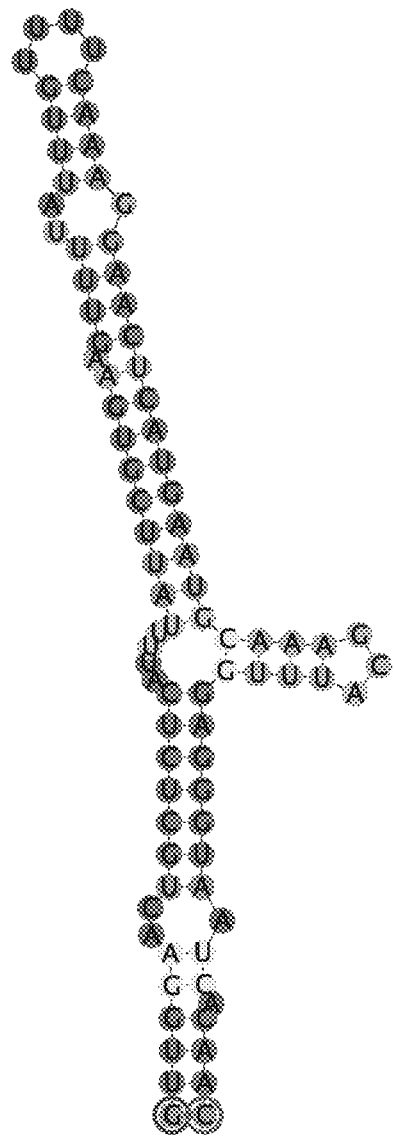
Figure 13R:
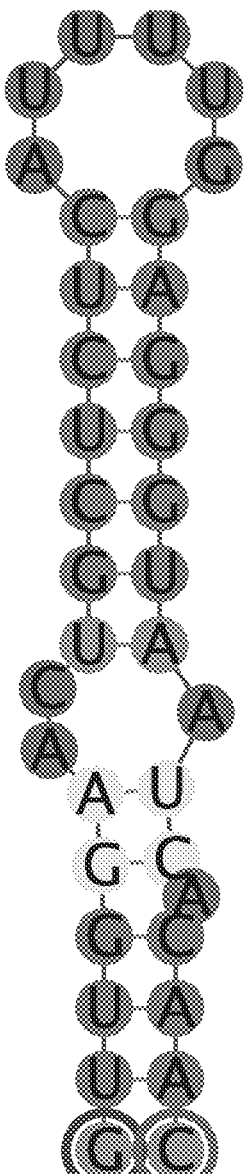
Figure 13S:
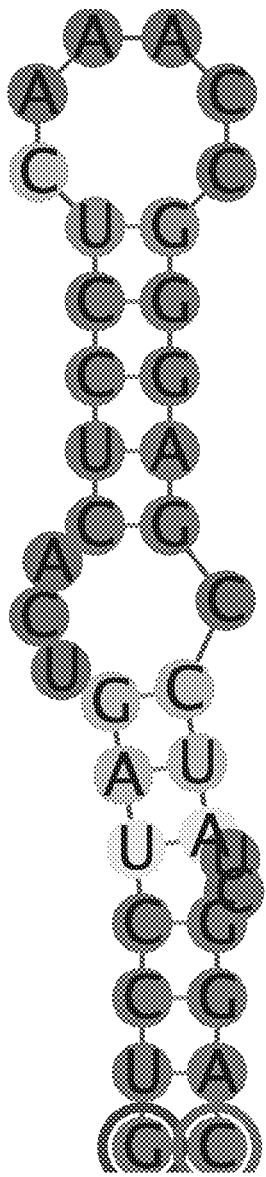
Figure 13T:
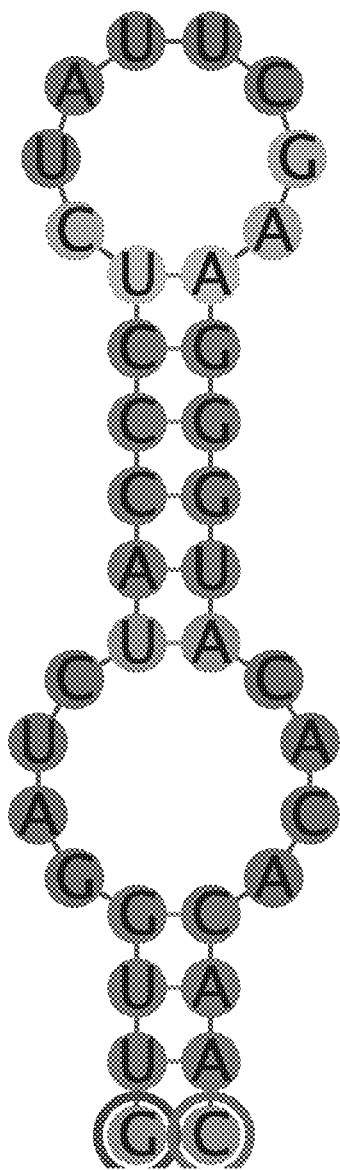
Figure 13U:
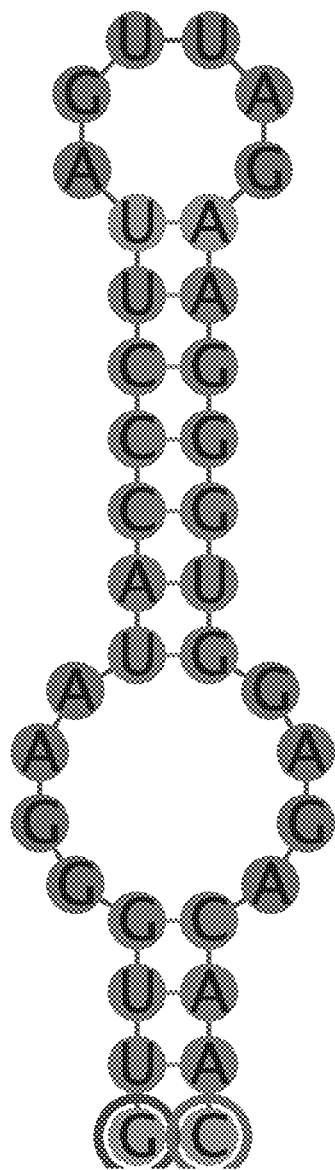
Figure 13V:
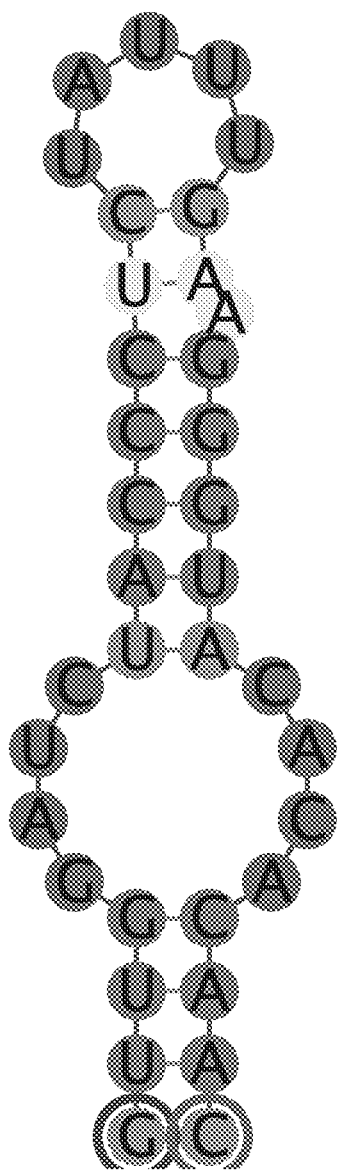
Figure 13W:
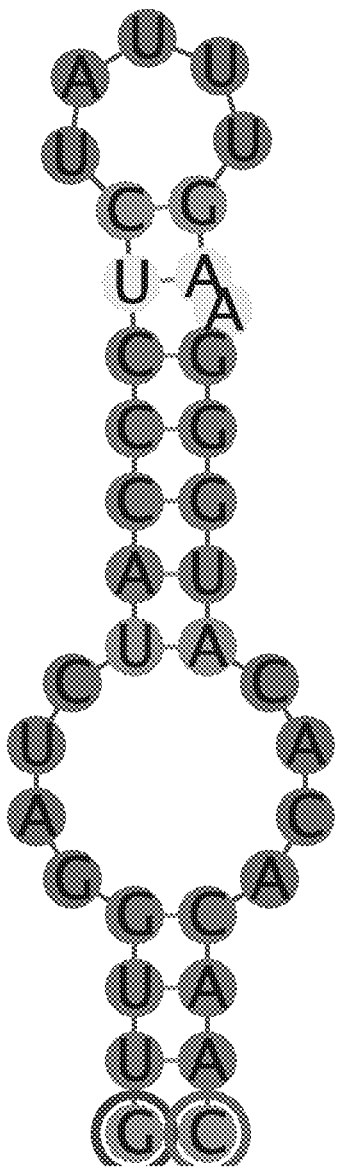
Figure 13X:
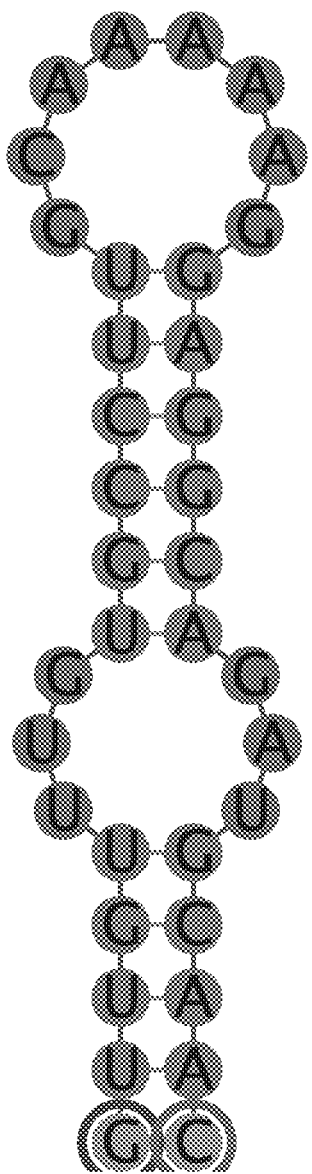
Figure 13Y:
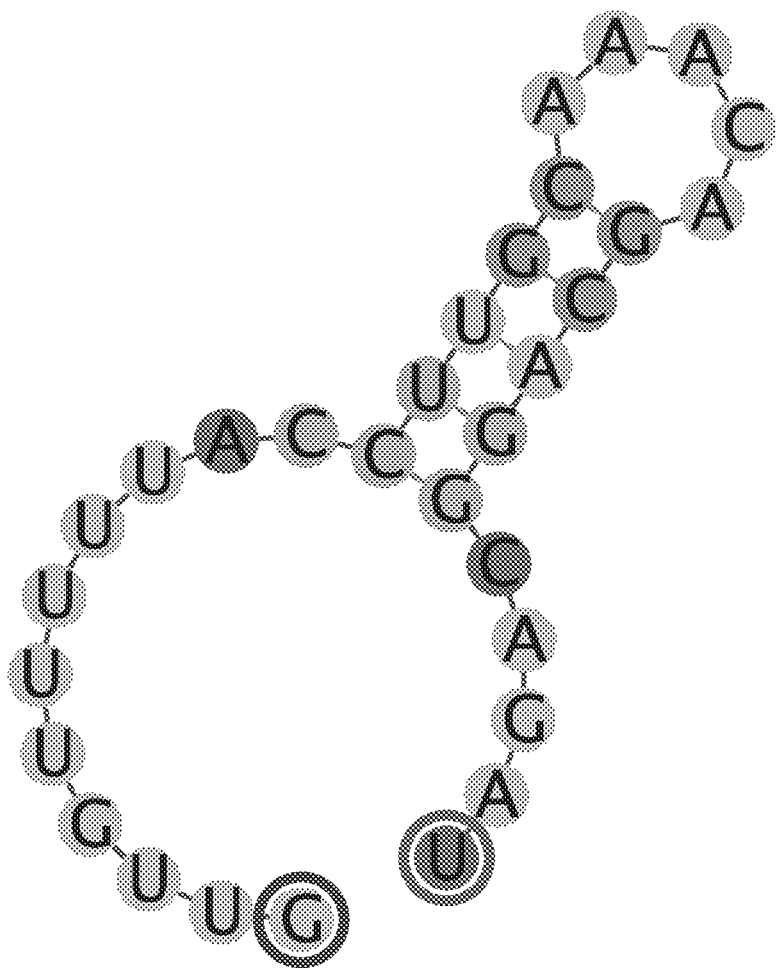
Figure 13Z:
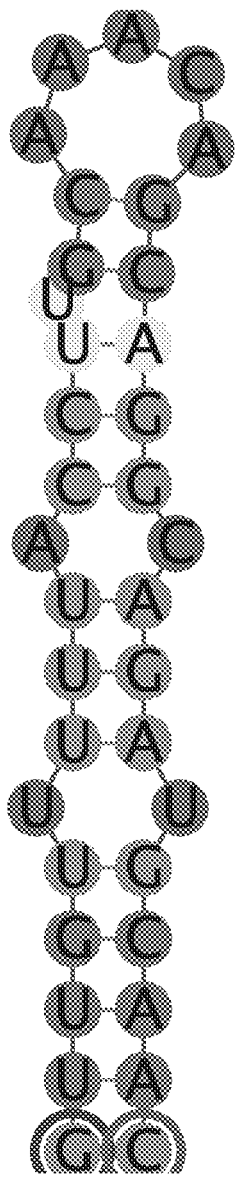
Figure 13A:
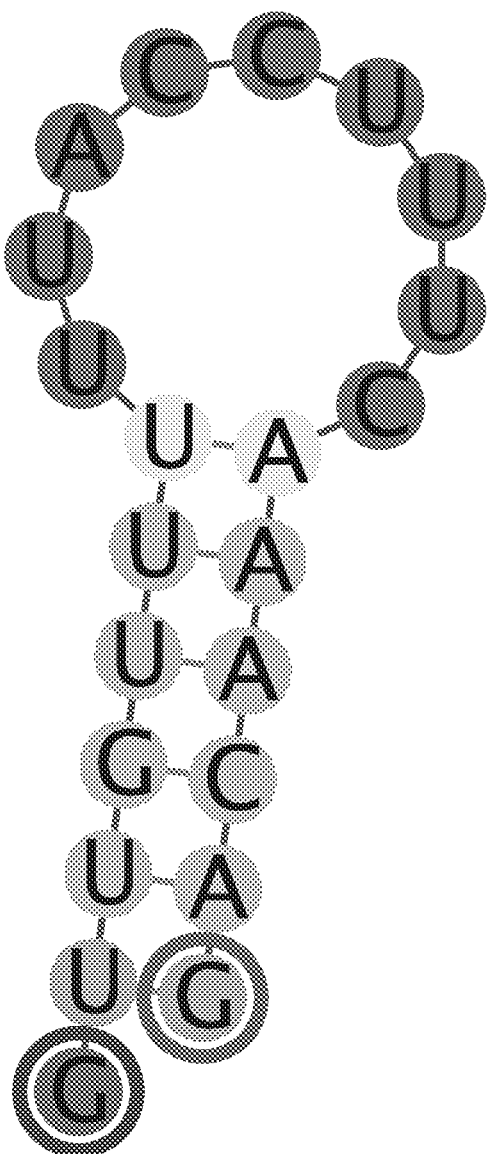
Figure 13B:
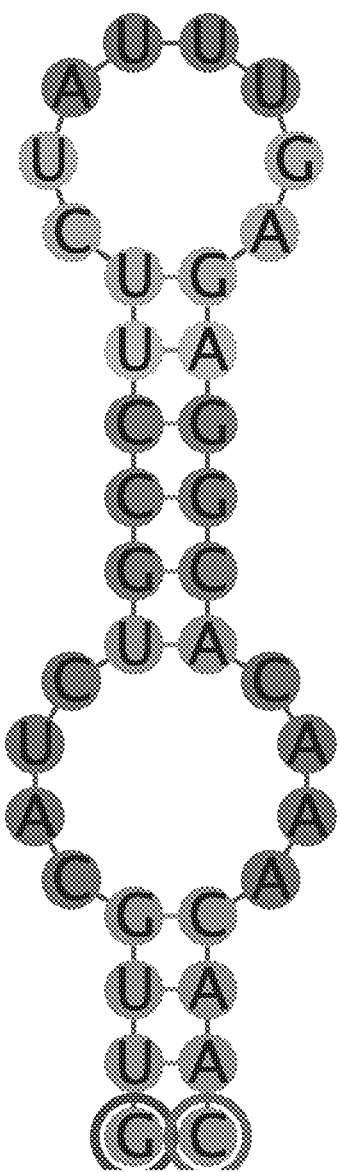
Figure 13C:
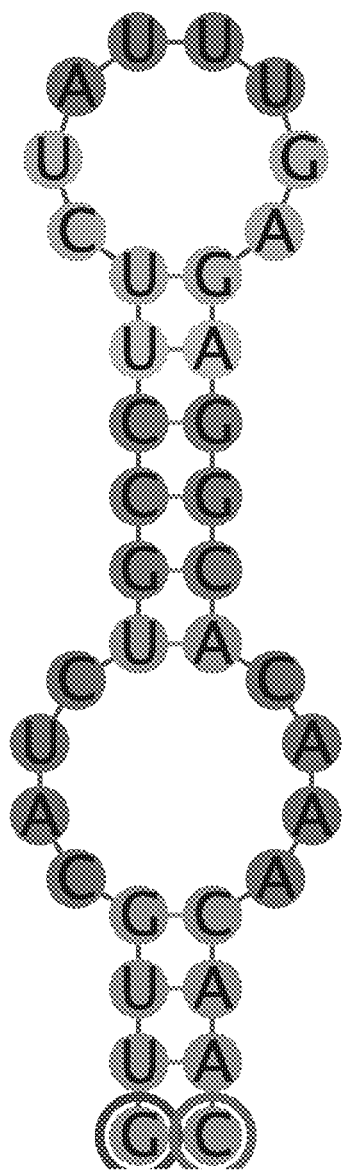
Figure 13D:
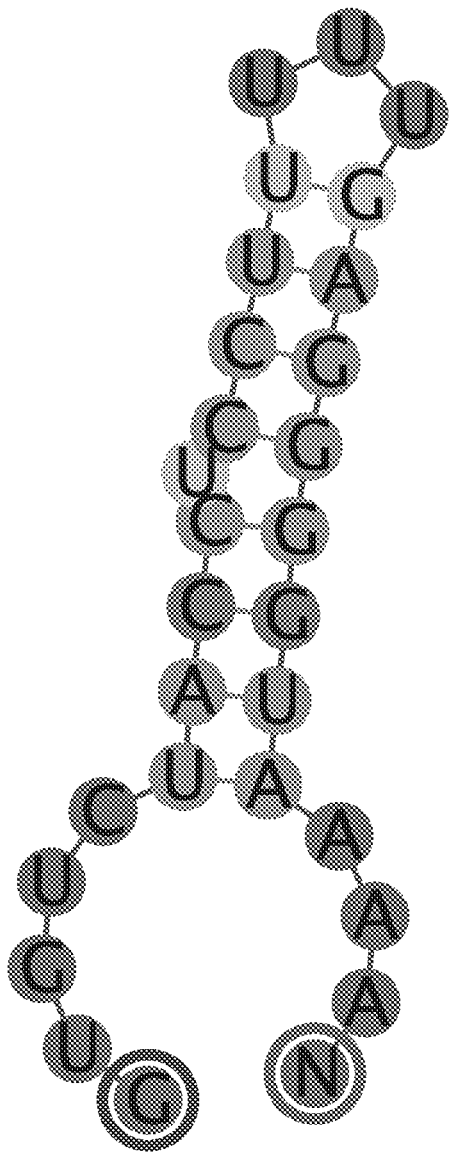
Figure 13E:
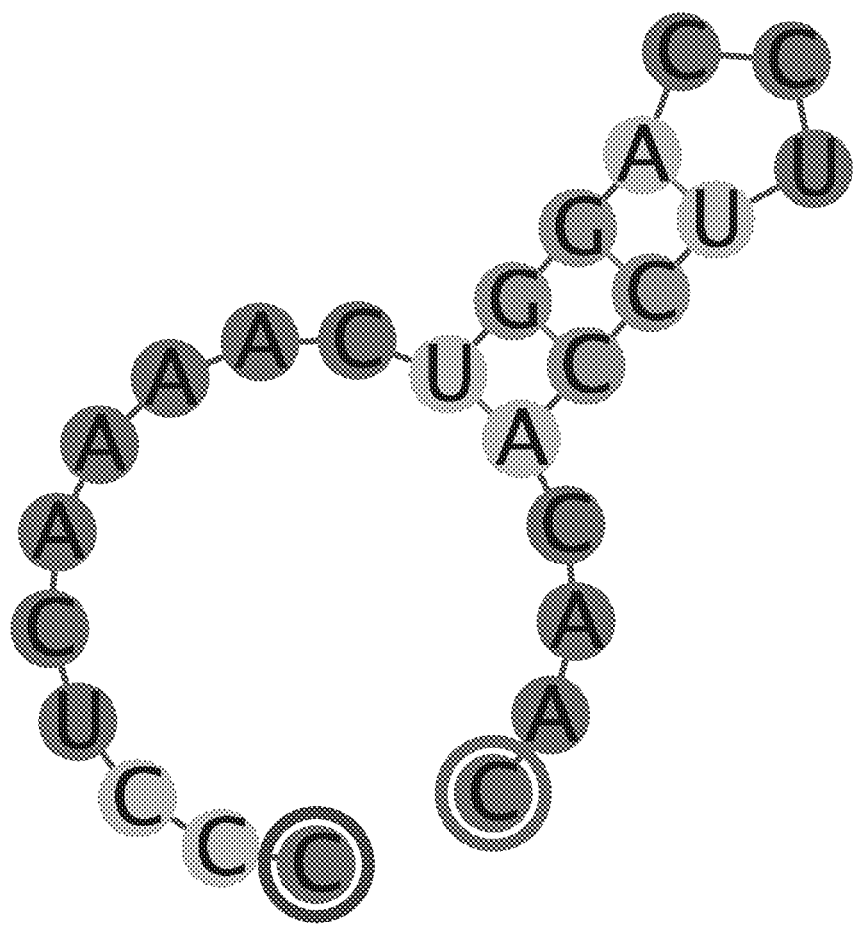
Figure 13F:
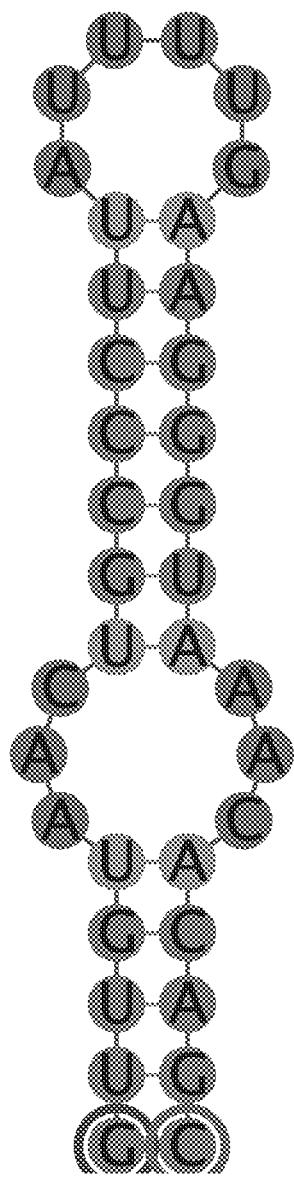
Figure 14A:
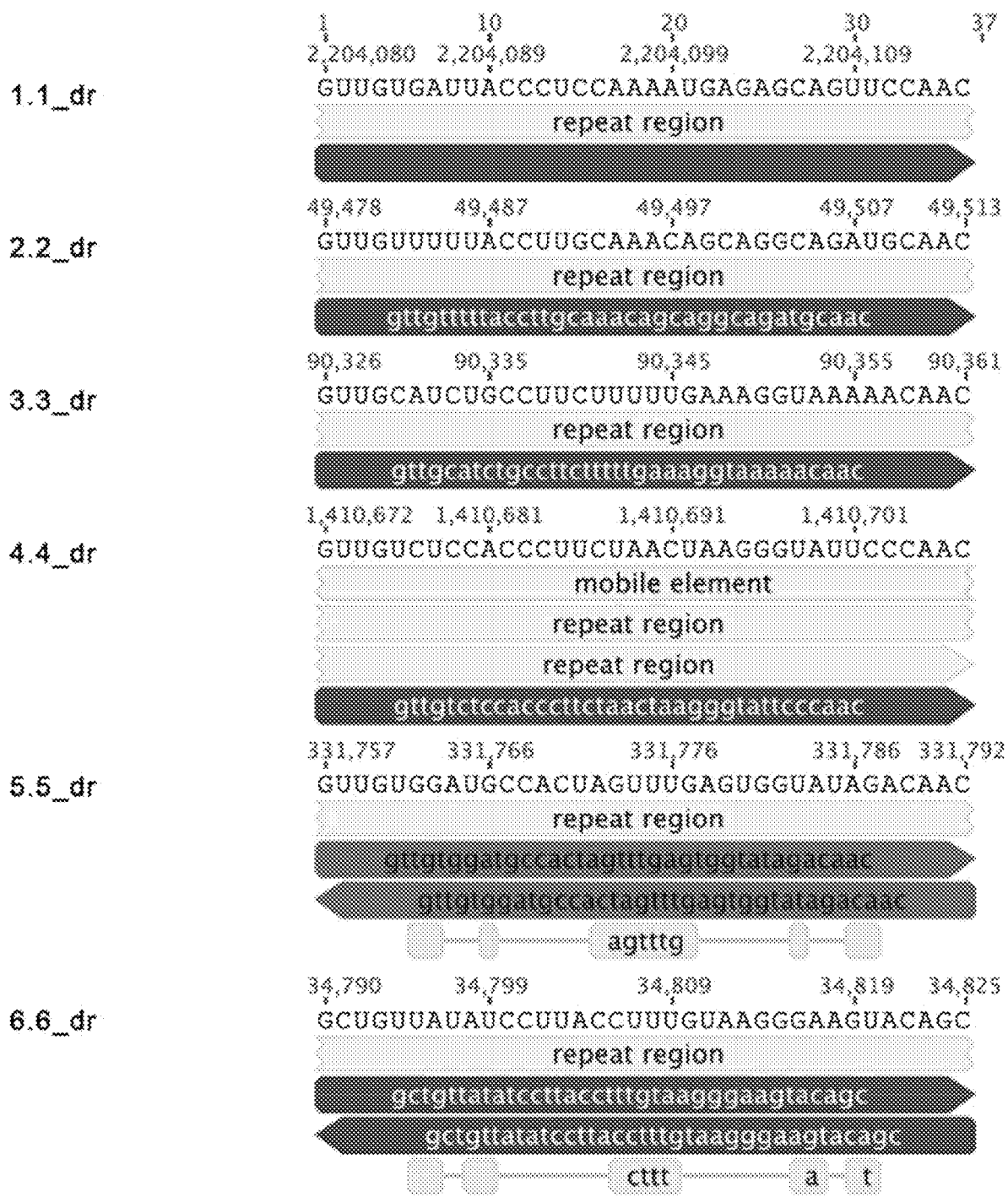
Figure 14C:
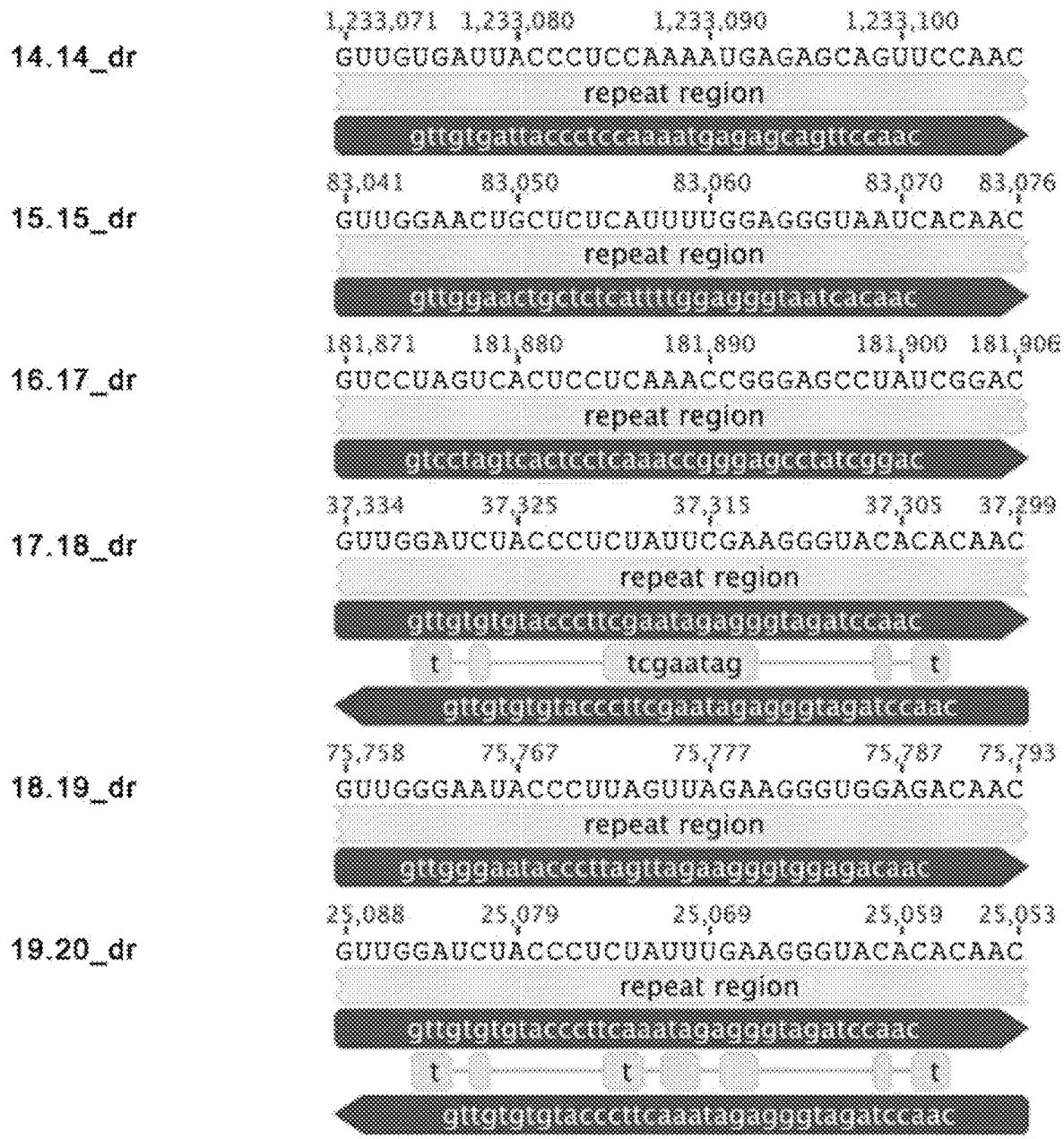
Figure 14D:
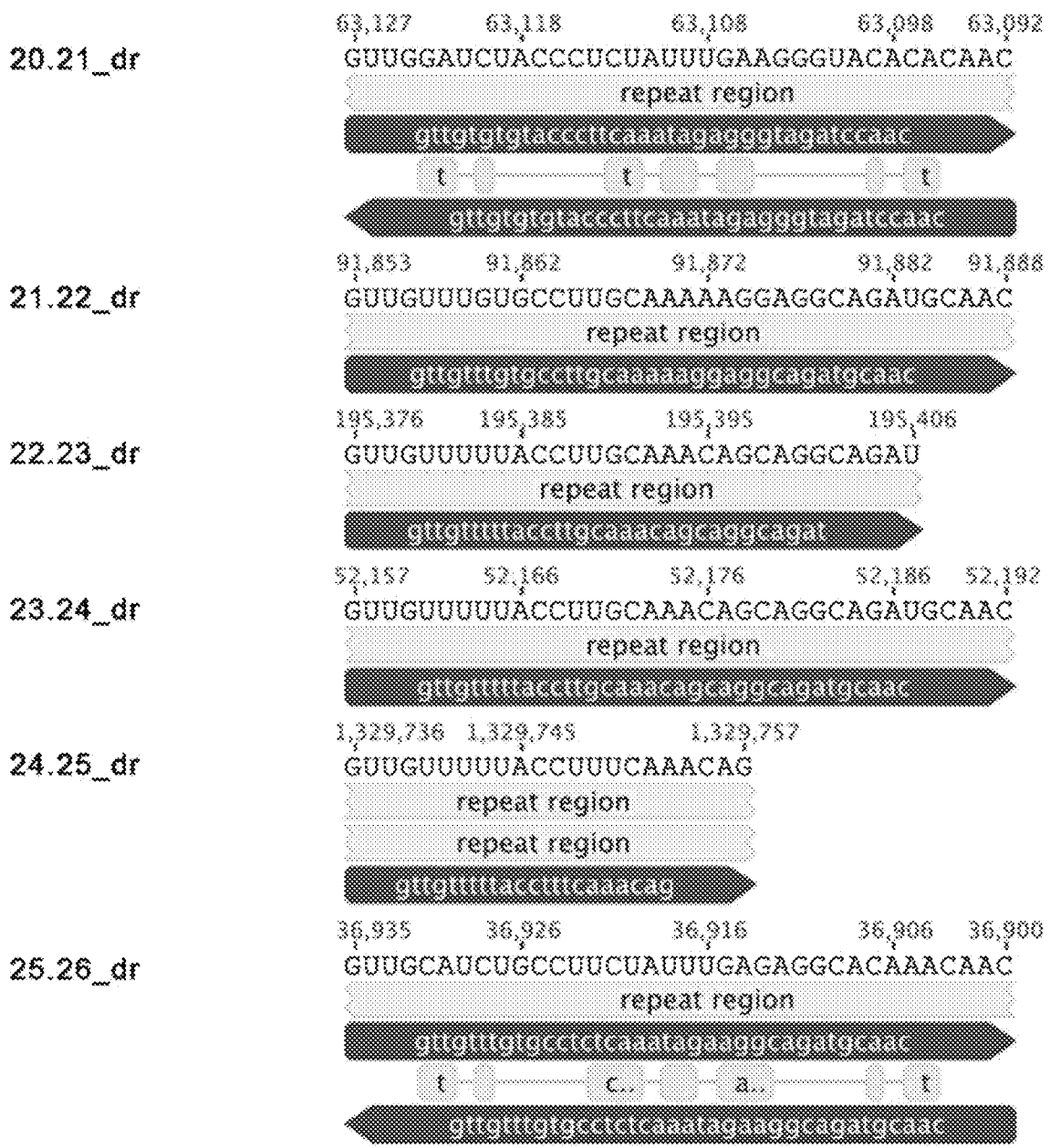
Figure 14E:
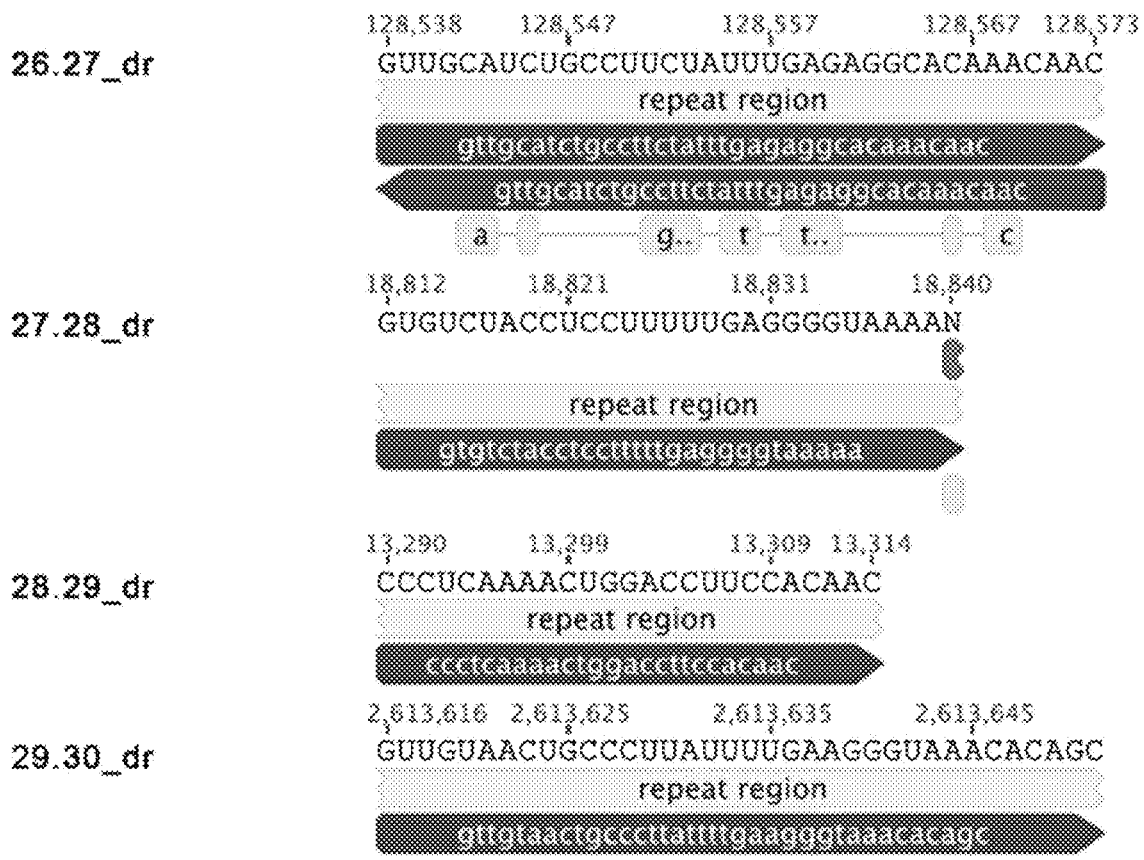
Figure 15:
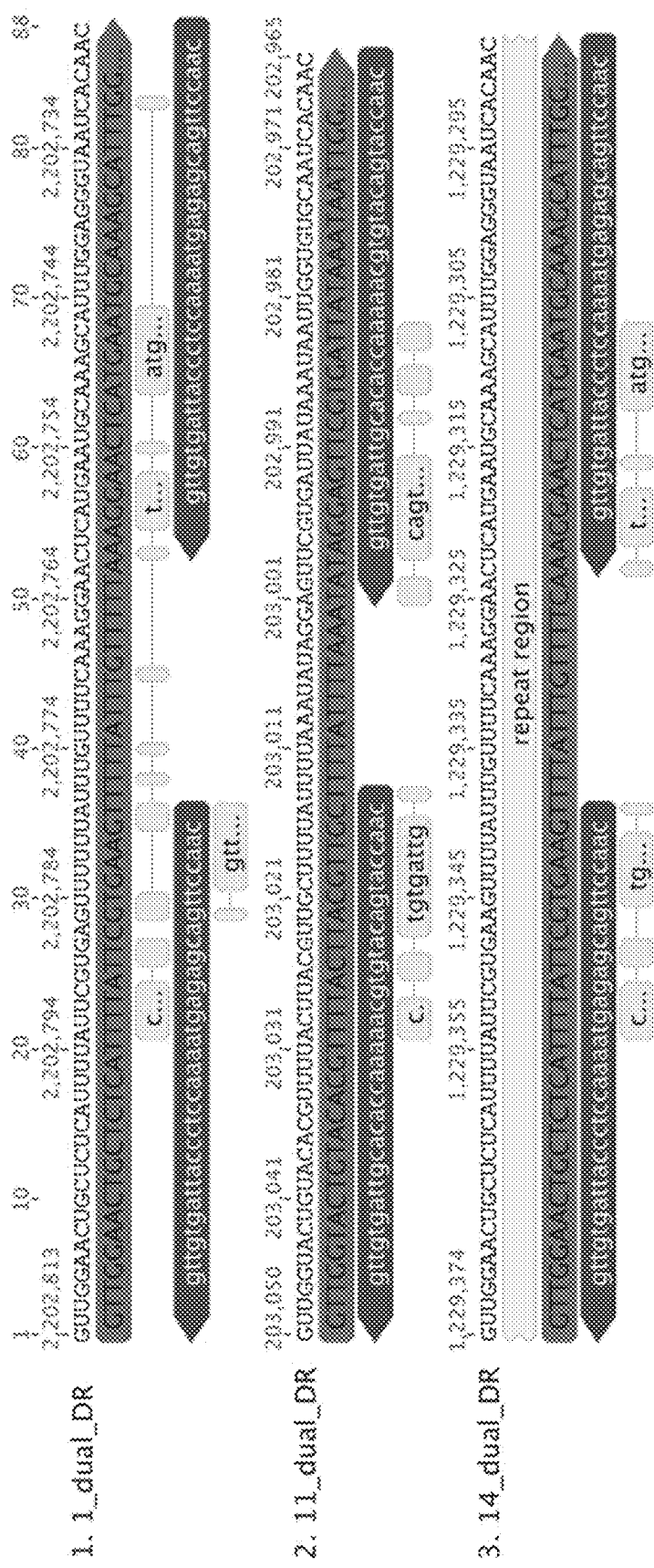
FIG. 15 shows select unique Group 29 dual direct repeat sequences. (SEQ ID Nos. 698 through 702)
Figure 16A:
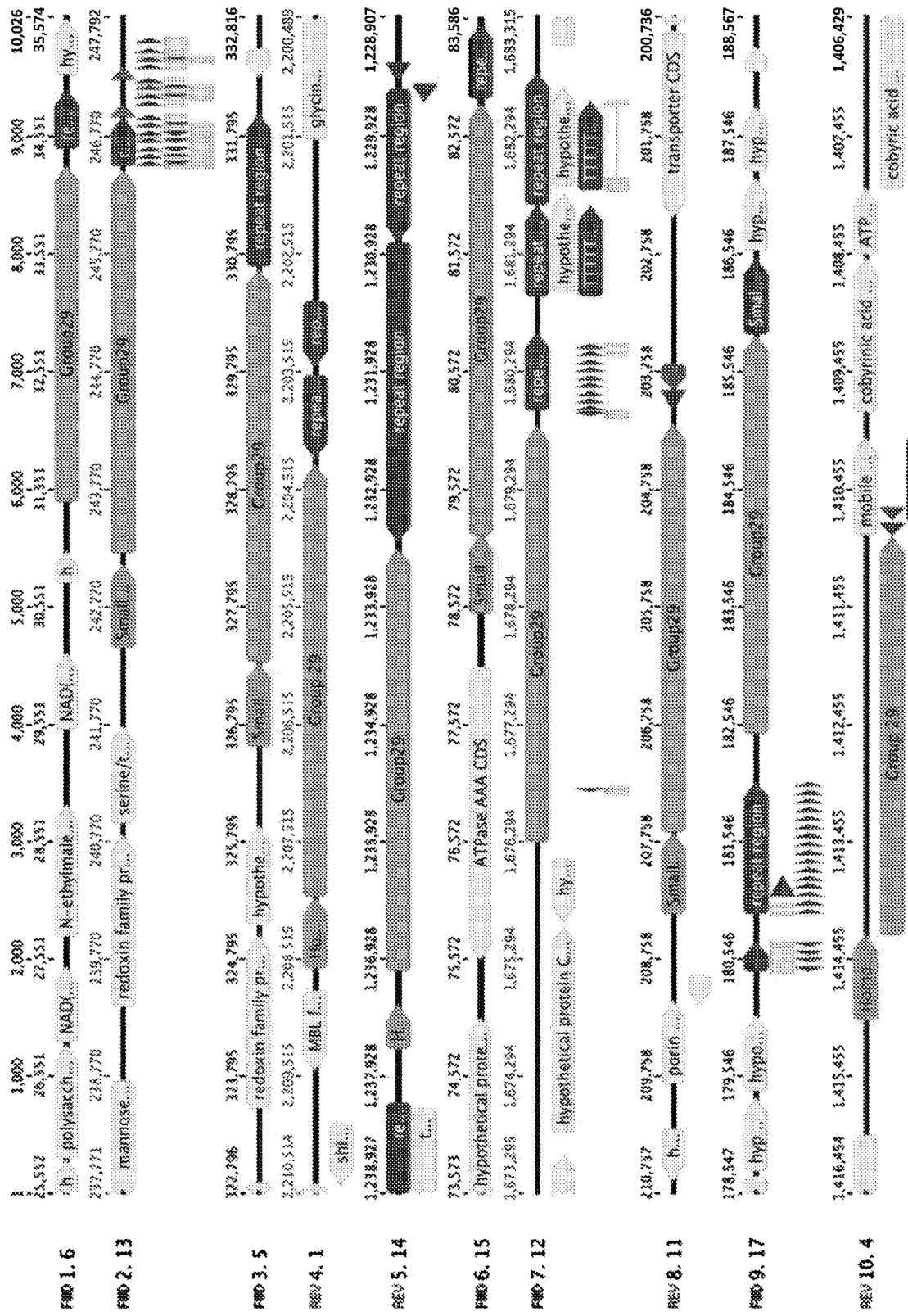
Figure 16C:
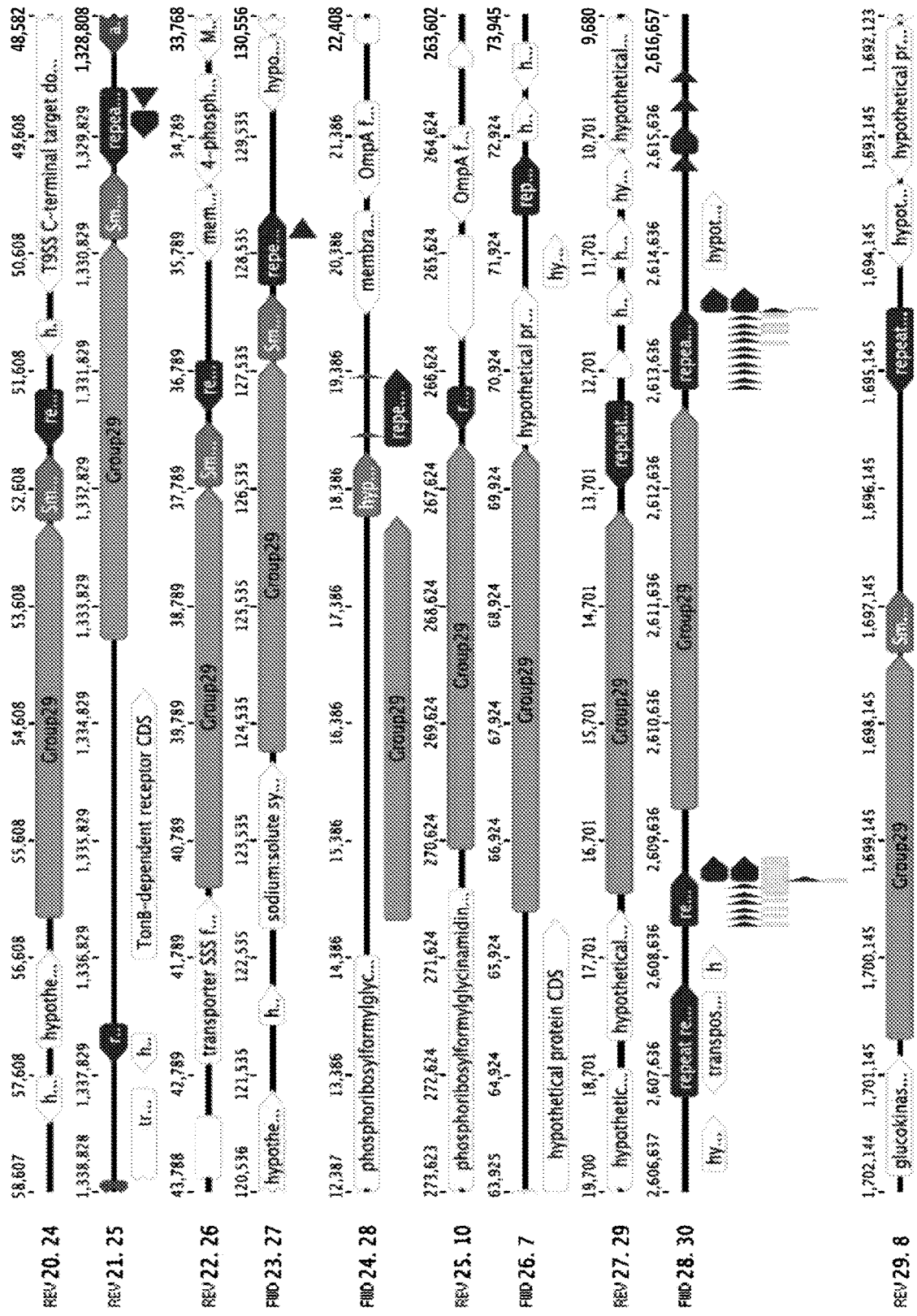
Figure 17A:
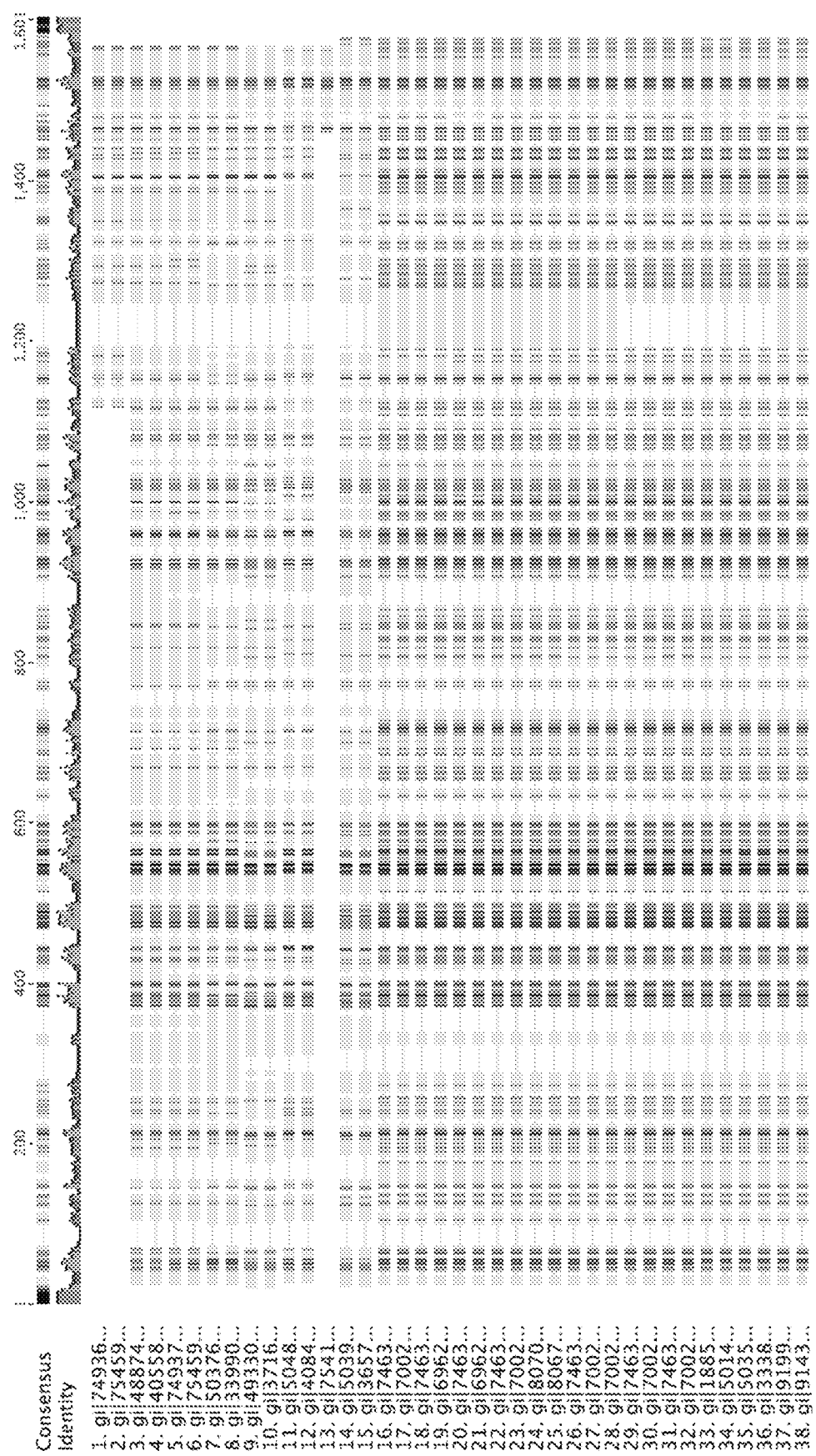
FIGS. 17A-17D show the amino acid alignment of all Group 29 proteins.
Figure 17B:
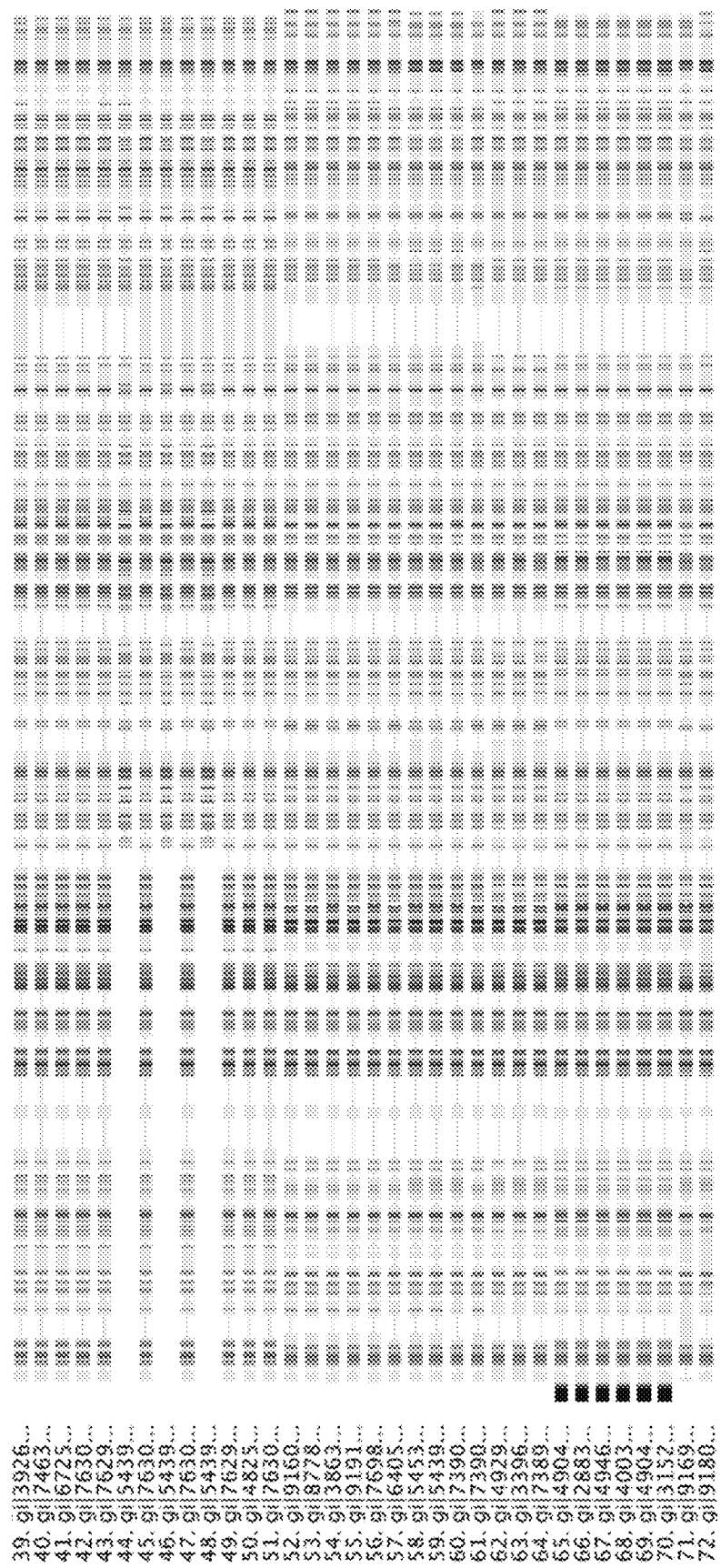
Figure 17C:
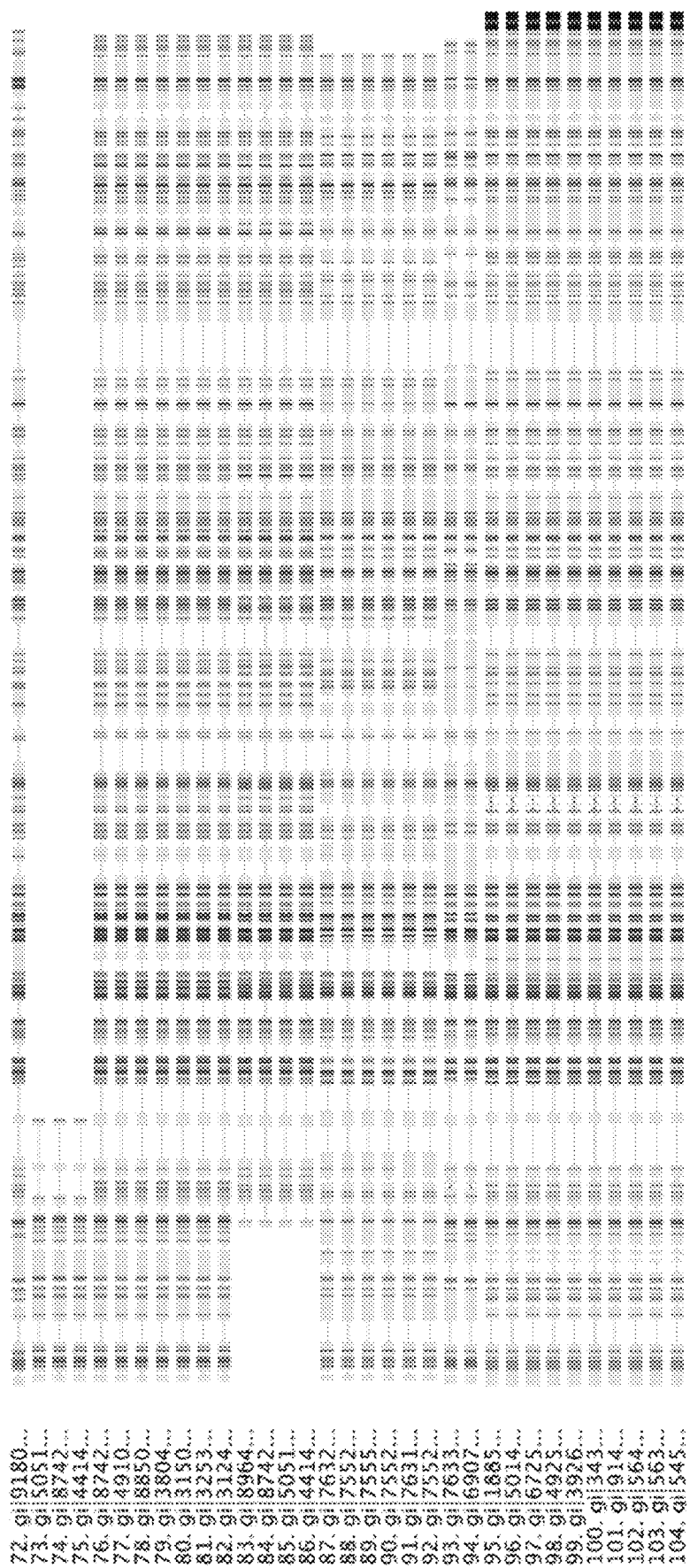
Figure 17D:
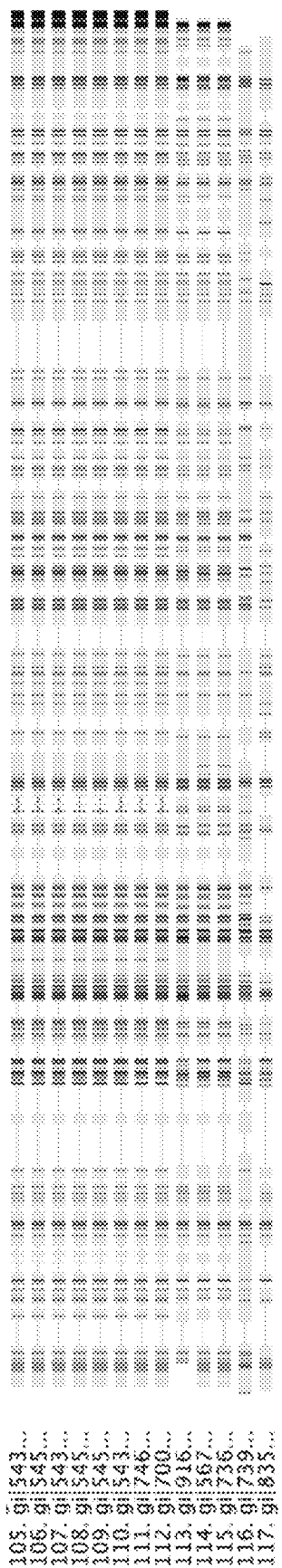
Figure 18B:
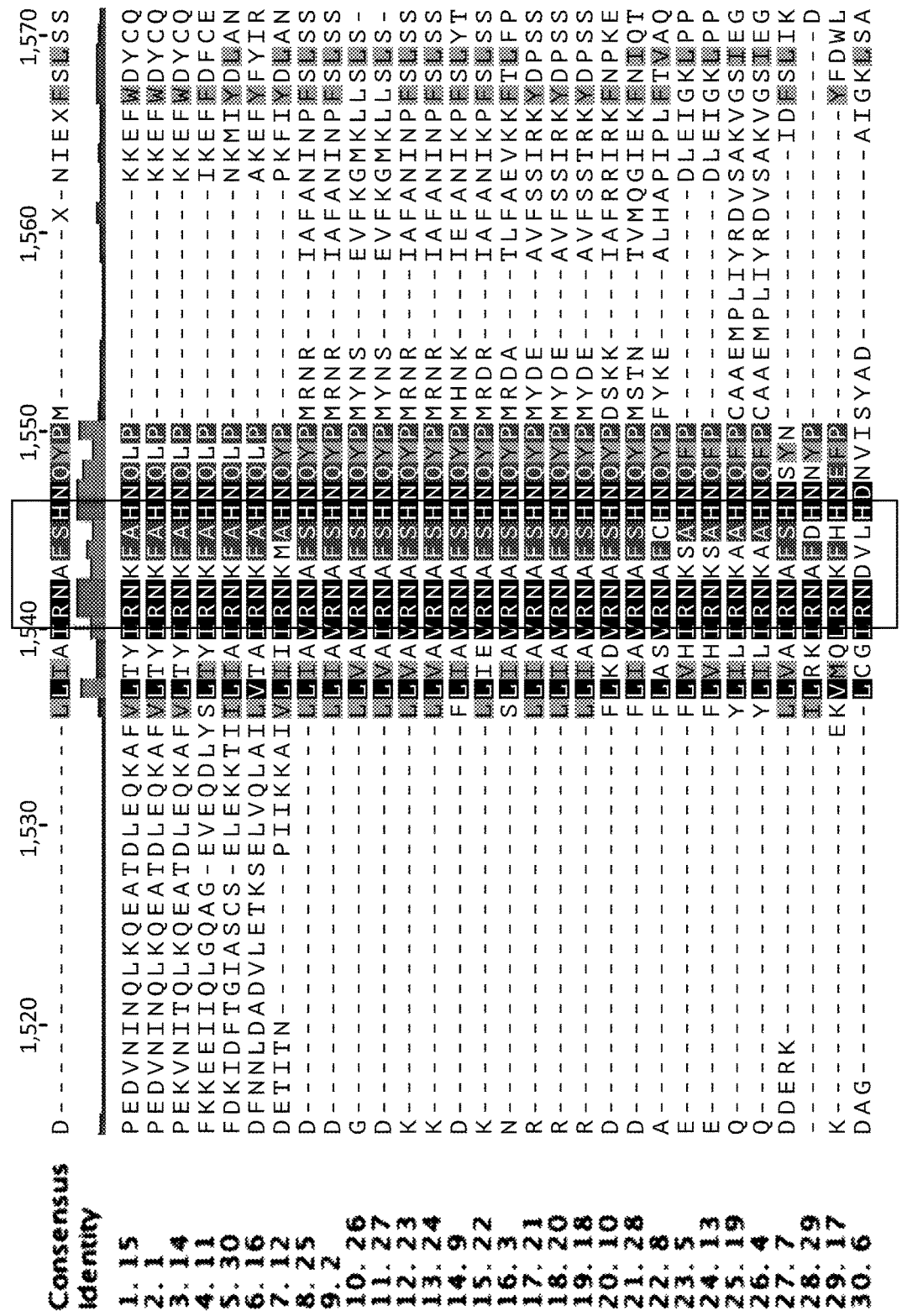
Figure 19:
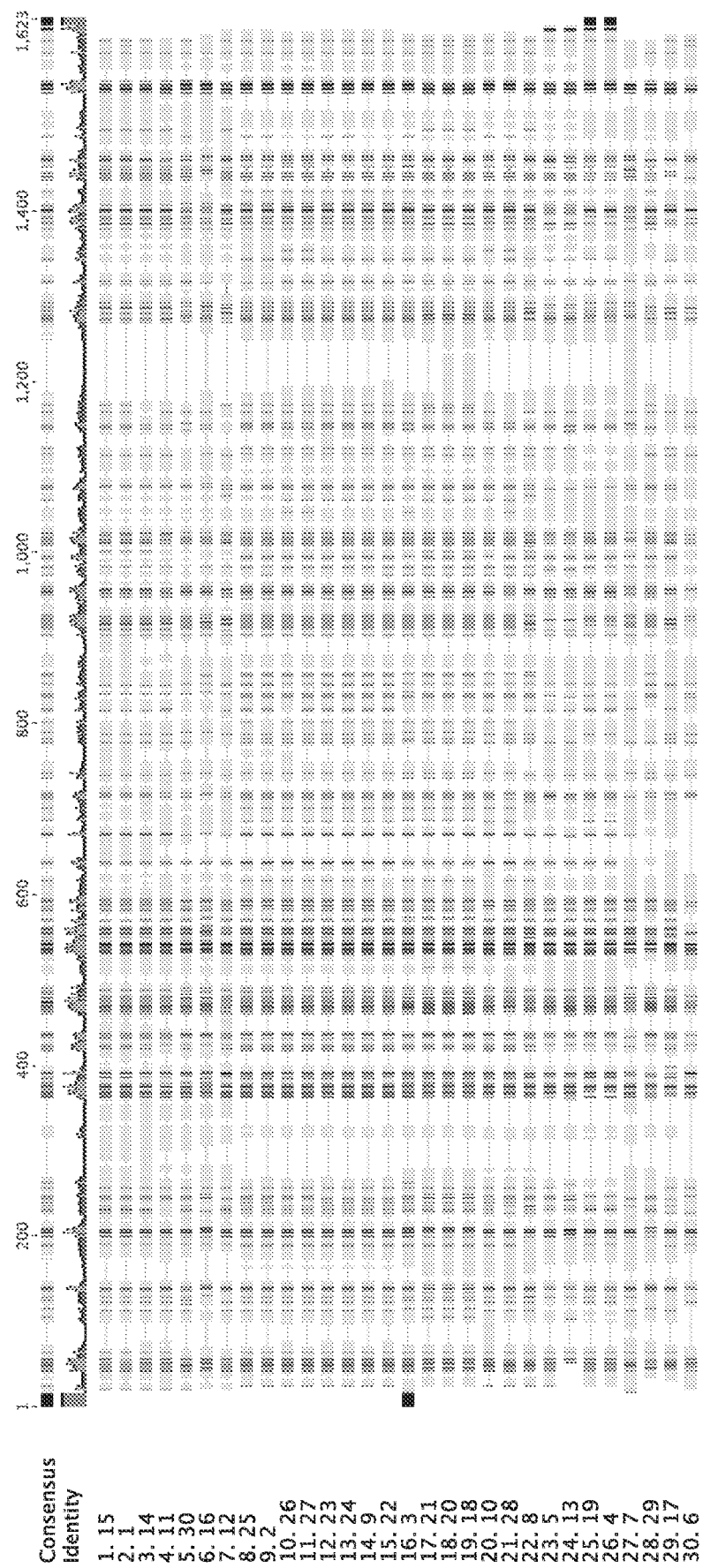
FIG. 19 shows the HEPN domains indicated at N terminus and C terminus of select unique Group 29 proteins (reference numbering in FIG. 7).
Figure 20:
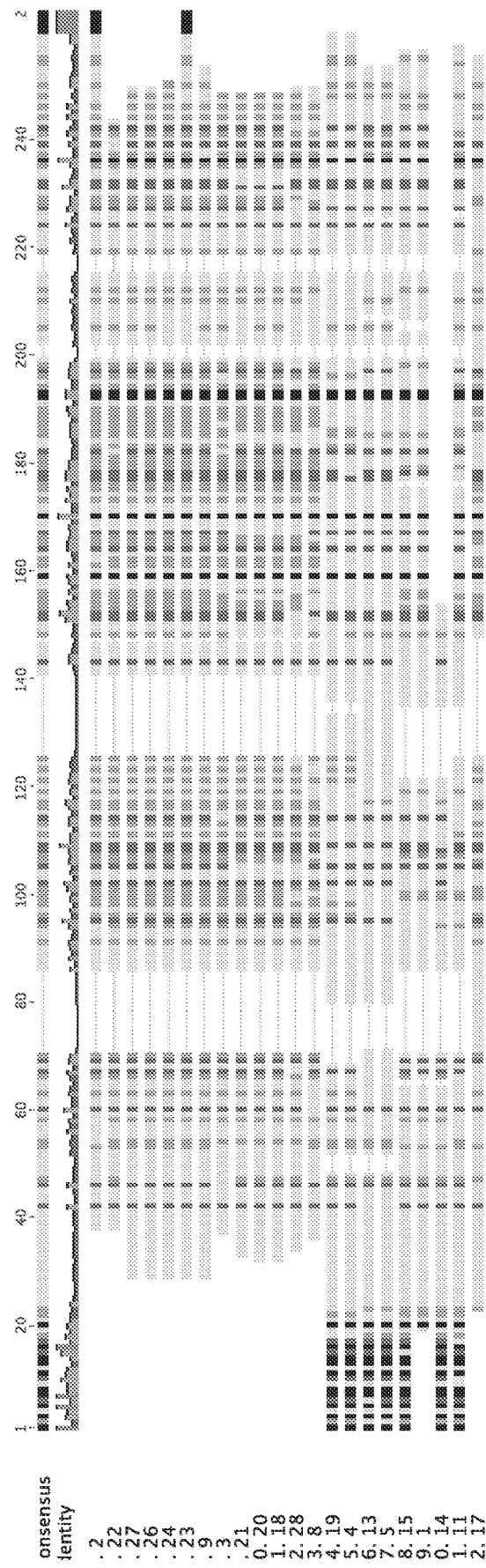
FIG. 20 shows the amino acid alignment of accessory small proteins to select subset of unique Group 29 proteins.
Figure 21:
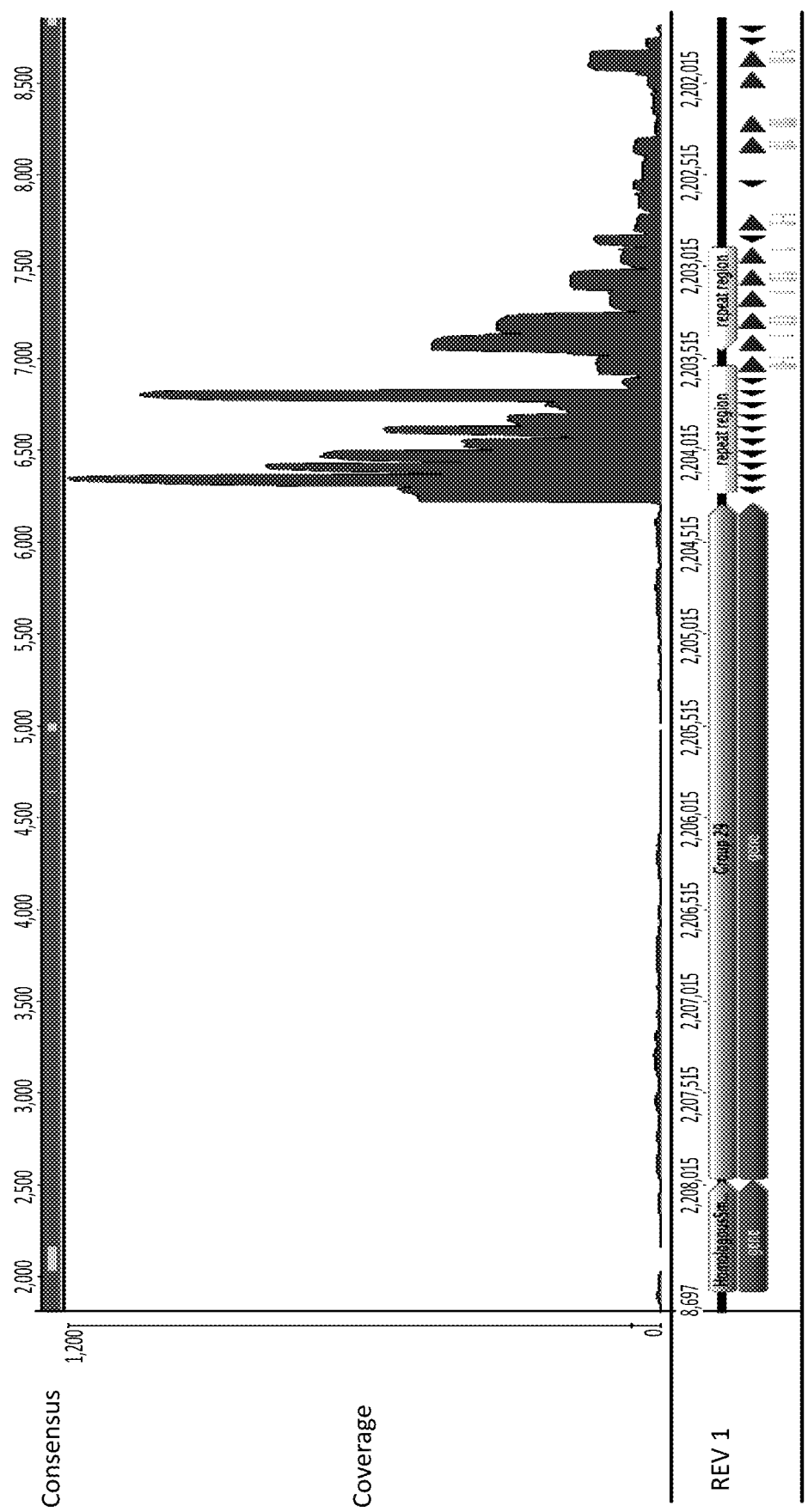
FIG. 21 shows the analysis of RNA-Seq data for *Bergeyella zoohelcum*, with direction of transcription from left to right.
Figure 22:
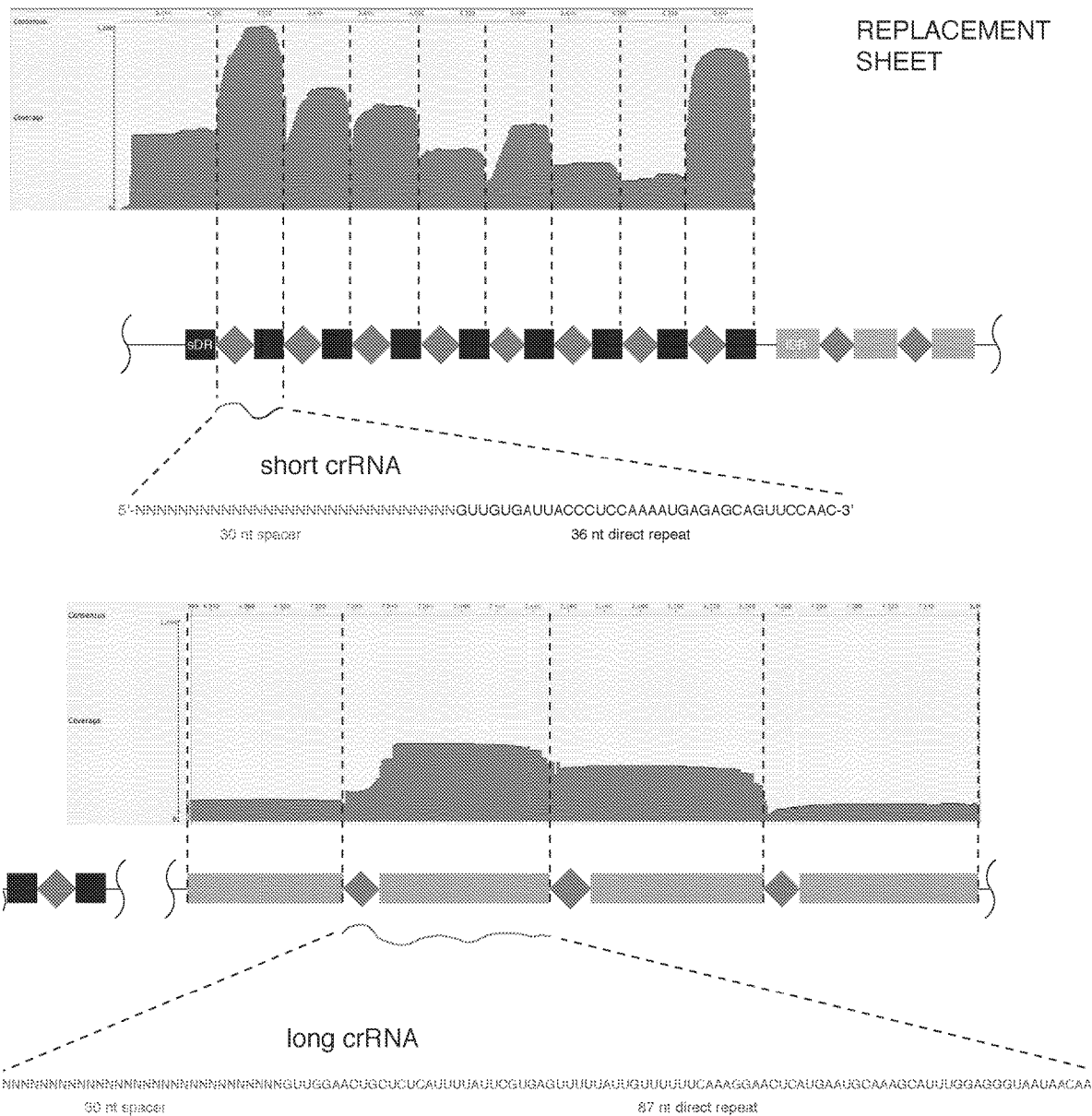
FIG. 22 shows a comparison of short DRs and long DRs of RNA transcripts, from which we discovered short crRNAs and long crRNAs (with dual direct repeats.) (SEQ ID Nos. 734 and 735)
Figure 23:
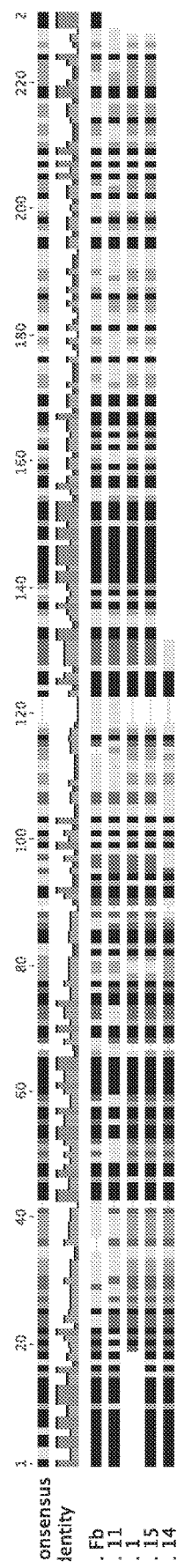
FIG. 23 shows Fb short protein homology.
Figure 24:
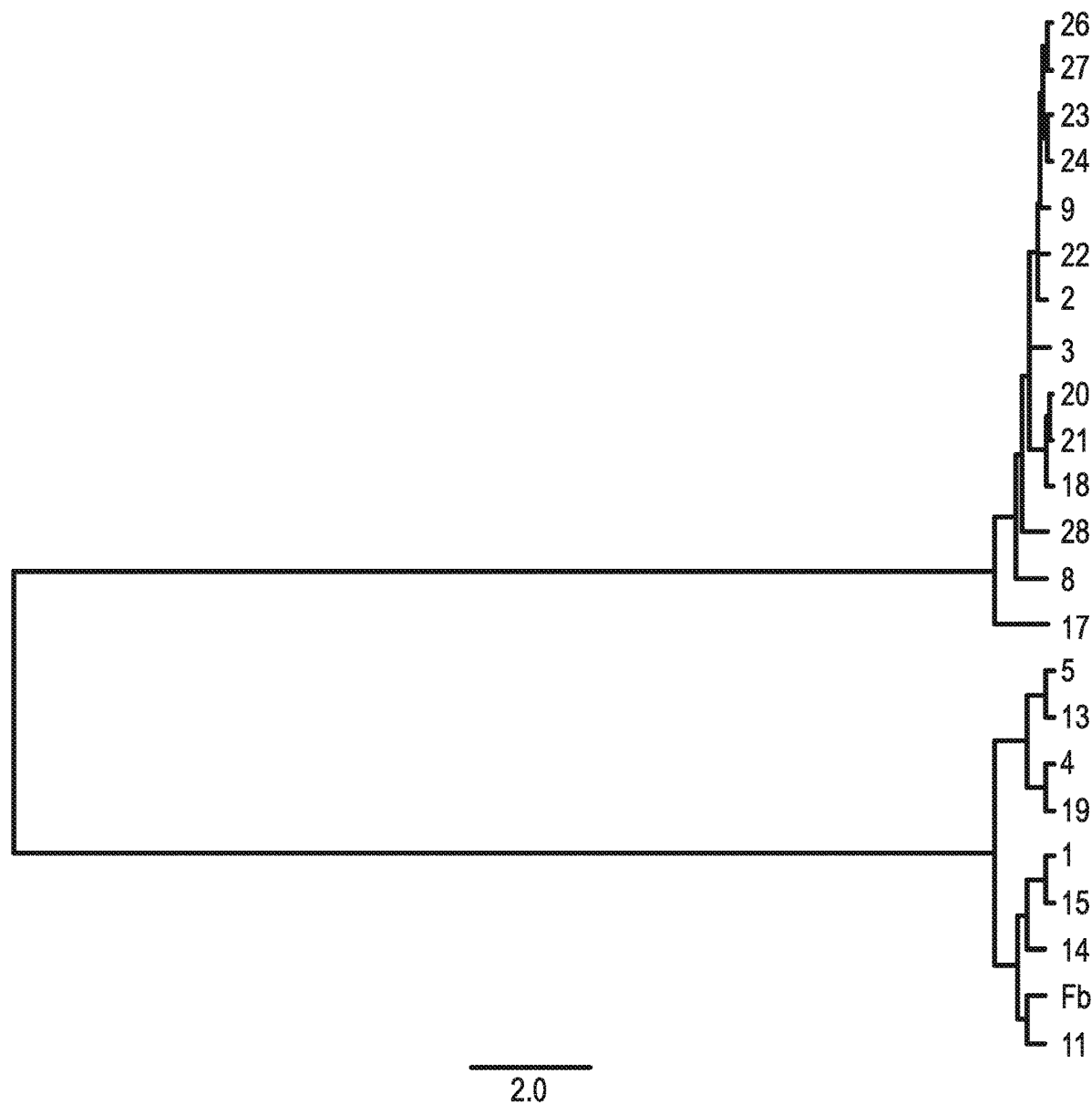
FIG. 24 shows the Fb short protein tree.
Figure 25:
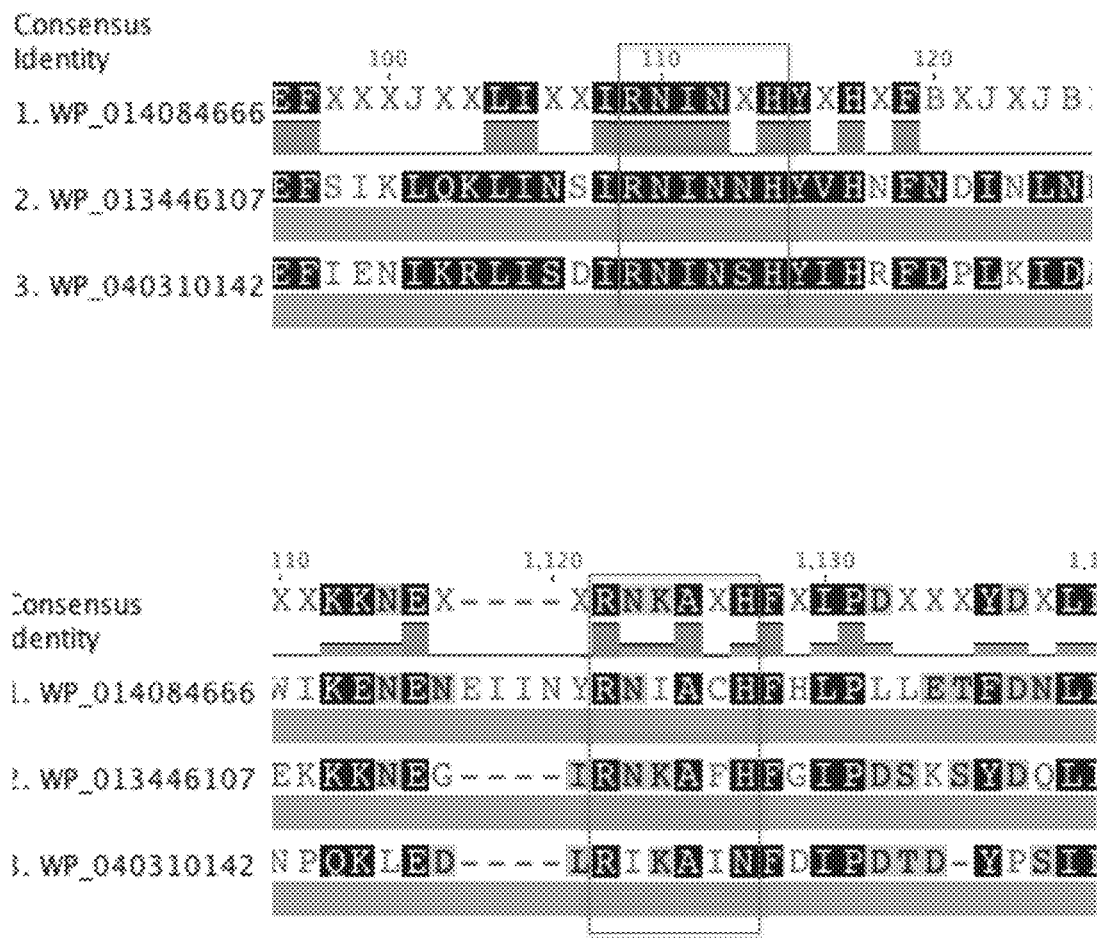
FIG. 25 shows the HEPN domains in Group 30 proteins. (SEQ ID Nos. 736 through 739)
Figure 26:
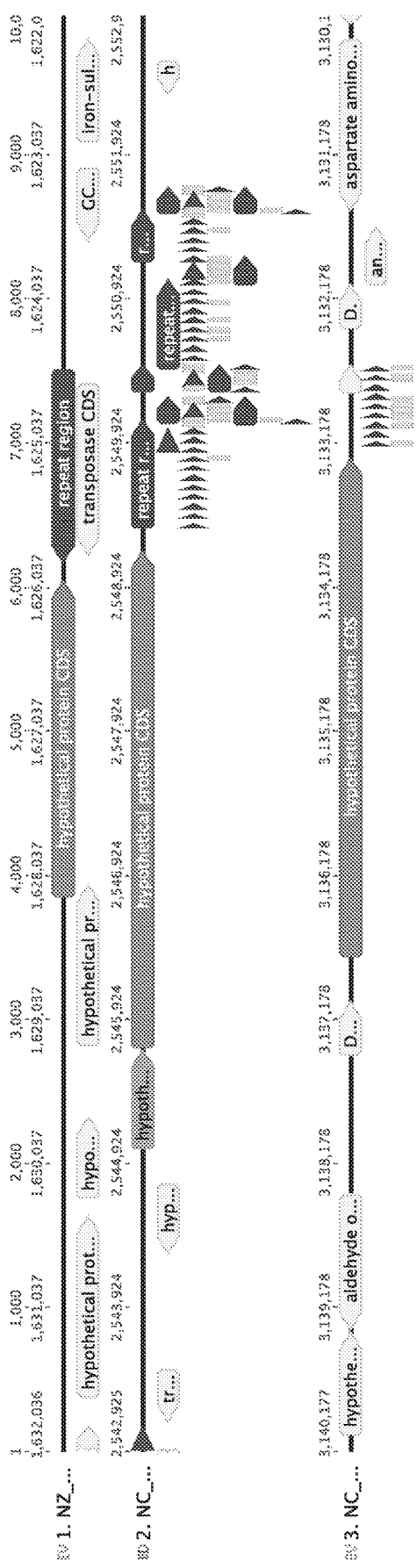
FIG. 26 shows the loci organization of Group 30 proteins.
Figure 27:
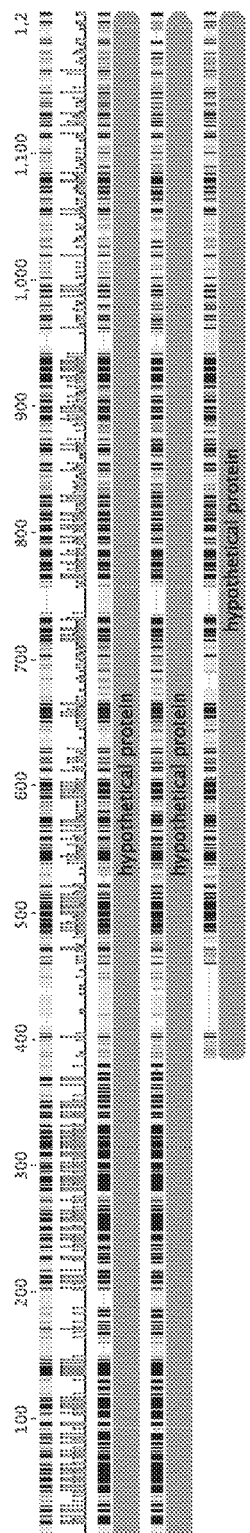
FIG. 27 shows the protein alignment of Group 30 proteins.
Figure 28:
FIG. 28 shows the Group 30 protein tree.
Figure 29:
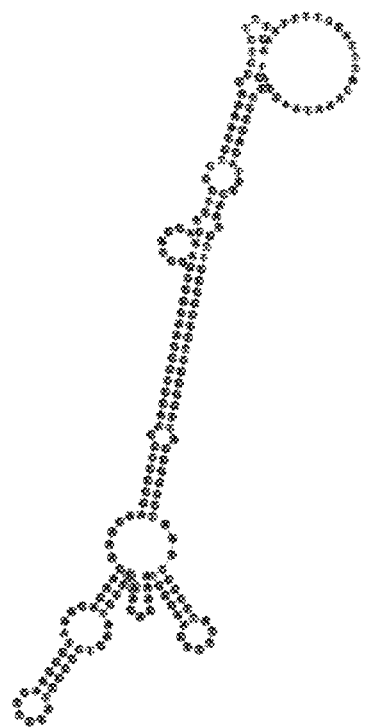
FIG. 29 shows the fold structure of Fb long DR. (SEQ ID NO: 740)
Figure 30:
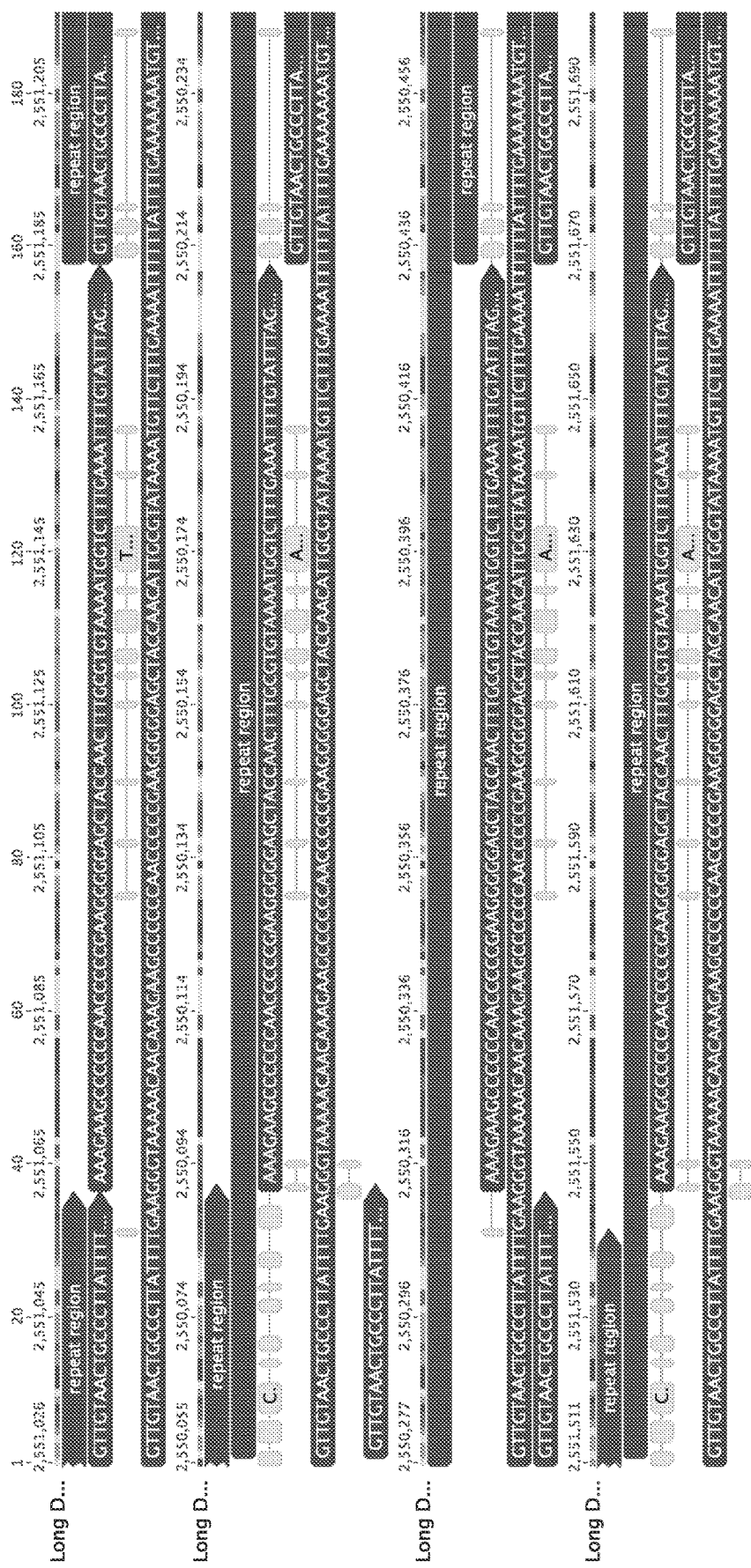
FIG. 30 shows the Fb long DR. (SEQ ID Nos. 741 through 756)
Figure 31:
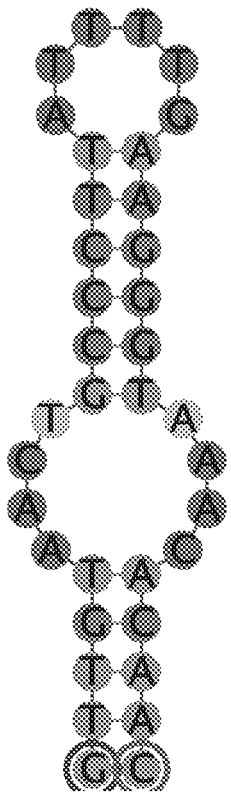
FIG. 31 shows the fold structure of Fb short DR. (SEQ ID Nos. 757)
Figure 33:
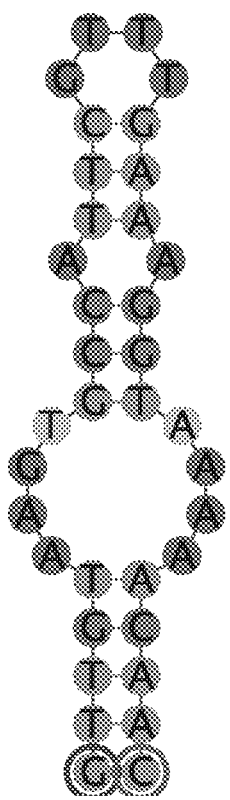
FIG. 33 shows the fold structure of Pp short DR. (SEQ ID Nos. 758)

Protocol of FIG. 40: Protocol for all N² tiling experiments.

Now salt concentration will be 50 mM (2.708 µL of 2M NaCl in a 100 µL rxn)

6. Normalize short crRNA to 36.5 ng/pL (5 µL in 8.7 µL ddH₂O).
7. Dilute frozen protein. (8.1 µL in 21.9 H₂O.) Need 24 (make 30) samples (1 µL per sample), 0.27 µg per rxn. New stock is at 1 µg/µL; 2000 mM NaCl.
8. Normalize each PAM library to 100 ng/uL (5 µL in 45 µL ddH₂O)
9. Make 10× Buffer w/DTT (Add 10 µL DTT to 90 µL of 10× buffer without DTT).
10. Make Master Mixes:

EGFP Target 1

| | | |
|---|---|---|
| RNAse Inhibitor | 1 µL | 30 µL |
| 10x Buffer w/DTT | 1 µL | 30 µL |
| ddH₂O | 5 µL × 30 | 150 µL |
| E1 (20 ng/uL) | 1 µL | 30 µL |
| Total | 8 µL | |

1. Aliquot 8 µL MM.
2. Add 1 µL of protein or ddH2O to each well.
3. Add 1 µL of short crRNA (36.5 ng/µL) or ddH₂O to each well.
4. Mix components.
5. Incubate for 60 min at 37° C. Then heat inactivate for 5 minutes at 85° C.
6. Prot K treat: 1 µL per sample for 15 min @ RT.
7. Run TBE urea gel.

FIG. 40 shows the results of an in vitro cleavage assay of an EGFP RNA (A: Target 1; B: Target 2; see FIG. 41; 100 ng) by Group 29 proteins (purified from *Bergeyella zoohelcum* ATCC 43767). 20 targets chosen randomly while represent N^2 nucleotides (i.e. AA, AC, AT, AG, . . . , GT, GG) on either side of 30 nucleotide target sequences. Reactions were in 50 mM NaCl, pH 7.5 (10 mM Tris-HCl), 0.1% BSA, 1 mM DTT, and conducted for 60 min at 37° C. The molar ratio of protein to crRNA to target RNA was 1:1:1. Different crRNAs were evaluated, as indicated in FIG. 39. From FIG. 40 as well as Table 3 (Target 1) and Table 4 (Target 2), cleaving and non-cleaving guides (artificial sequences) can be distinguished.

TABLE 3

| Guide Index | Left Flank | Target | Right Flank | Target Position |
|---|---|---|---|---|
| Guides that cut: | | | | |
| 1 | CCTGGGGCAACAAGCT GGAGTACAACTACAA (SEQ ID NO. 260) | CAGCCACAACGTCTATATCATGGC CGACAA (SEQ ID NO: 261) | GCAGAAGAACGGCATCAAGG TGAACTTCAA (SEQ ID NO: 262) | 114 |
| 4 | ATCGAGCTGAAGGGCA TCGACTTCAGGAG (SEQ ID NO: 266) | GACGGCAACATCCTGGGGCACAAG CTGGAG (SEQ ID NO: 264) | TACAACTACAACAGCCACAA CGTCTATATC (SEQ ID NO: 265) | 73 |
| 8 | AACTACAACAGCCACA ACGTCTATATCATG (SEQ ID NO: 266) | GCCGACAAGCAGAAGAACGGCAT CAAGGTG (SEQ ID NO: 267) | AACTTCAAGATCCGCCACAA CATCGAGGAC (SEQ ID NO: 268) | 136 |
| 9 | TGAAGGGCATCGACTT CAAGGAGGACGGCA (SEQ ID NO: 269) | ACATCCTGGGGCACAAGCTGGAGT ACAACT (SEQ ID NO: 270) | ACAACAGCCACAACGTCTAT ATCATGGCCG (SEQ ID NO: 271) | 80 |
| 10 | ACATCCTGGGGCACAA GCTGGAGTACAACT (SEQ ID NO: 272) | ACAACAGCCACAACGTCTATATCA TGGCCG (SEQ ID NO: 273) | ACAAGCAGAAGAACGGCATC AAGGTGAACT (SEQ ID NO: 274) | 110 |
| 13 | ACGTCTATATCATGGC CGACAAGCAGAAGA (SEQ ID NO: 275) | ACGGCATCAAGGTGAACTTCAAGA TCCGCC (SEQ ID NO: 276) | ACAACATCGAGGACGGCAGC GTGCAGCTCG (SEQ ID NO: 277) | 152 |
| 16 | GCATCGAGCTGAAGGG CATCGACTTCAAGG (SEQ ID NO: 278) | AGGACGGCAACATCCTGGGGCACA AGCTGG (SEQ ID NO: 279) | AGTACAACTACAACAGCCAC AACGTCTATA (SEQ ID NO: 280) | 71 |
| 19 | CAACTACAACAGCCAC AACGTCTATATCAT (SEQ ID NO: 281) | GGCCGACAAGCAGAAGAACGGCA TCAAGGT (SEQ ID NO: 282) | GAACTTCAAGATCCGCCACA ACATCGAGGA (SEQ ID NO: 283) | 135 |
| GUIDES THAT DIDN'T VISITBLY CUT: | | | | |
| 2 | GTACAACTACAACAGC CACAACGTCTATAT (SEQ ID NO: 284) | CATGGCCGACAAGCAGAAGAACG GCATCAA (SEQ ID NO: 285) | GGTGAACTTCAAGATCCGCC ACAACATCGA (SEQ ID NO: 286) | 132 |
| 3 | GGCAACATCCTGGGGC ACAAGCTGGAGTAC (SEQ ID NO: 287) | AACTACAACAGCCACAACGTCTAT ATCATG (SEQ ID NO: 288) | GCCGACAAGCAGAAGAACGG CATCAAGGTG (SEQ ID NO: 289) | 106 |
| 5 | GGAGTACAACTACAAC AGCCACAACGTCTA (SEQ ID NO: 290) | TATCATGGCCGACAAGCAGAAGAA CGGCAT (SEQ ID NO: 291) | CAAGGTGAACTTCAAGATCC GCCACAACAT (SEQ ID NO: 292) | 129 |

TABLE 3-continued

| Guide Index | Left Flank | Target | Right Flank | Target Position |
|---|---|---|---|---|
| 6 | CAAGCAGAAGAACGG CATCAAGGTGAACTT (SEQ ID NO.: 293) | CAAGATCCGCCACAACATCGAGGA CGGCAG (SEQ ID NO: 294) | CGTGCAGCTCGCCGACCACT ACCAGCAGAA (SEQ ID NO: 295) | 171 |
| 7 | AAGAACGGCATCAAGG TGAACTTCAAGATC (SEQ ID NO: 296) | CGCCACAACATCGAGGACGGCAGC GTGCAG (SEQ ID NO: 297) | CTCGCCGACCACTACCAGCA GAACACCCCC (SEQ ID NO: 298) | 178 |
| 11 | TACAACAGCCACAACG TCTATATCATGGCC (SEQ ID NO: 299) | GACAAGCAGAAGAACGGCATCAA GGTGAAC (SEQ ID NO: 300) | TTCAAGATCCGCCACAACATC GAGGACGGC (SEQ ID NO: 301) | 139 |
| 12 | AGCTGGAGTACAACTA CAACAGCCACAACG (SEQ ID NO: 302) | TCTATATCATGGCCGACAAGCAGA AGAACG (SEQ ID NO: 303) | GCATCAAGGTGAACTTCAAG ATCCGCCACA (SEQ ID NO: 304) | 125 |
| 14 | ACGGCAACATCCTGGG GCACAAGCTGGAGT (SEQ ID NO: 305) | ACAACTACAACAGCCACAACGTCT ATATCA (SEQ ID NO: 306) | TGGCCGACAAGCAGAAGAAC GGCATCAAGG (SEQ ID NO: 307) | 104 |
| 15 | TATATCATGGCCGACA AGCAGAAGAACGGC (SEQ ID NO: 308) | ATCAAGGTGAACTTCAAGATCCGC CACAAC (SEQ ID NO: 309) | ATCGAGGACGGCAGCGTGCA GCTCGCCGAC (SEQ ID NO: 310) | 157 |
| 17 | TGGAGTACAACTACAA CAGCCACAACGTCT (SEQ ID NO: 311) | ATATCATGGCCGACAAGCAGAAGA ACGGCA (SEQ ID NO: 312) | TCAAGGTGAACTTCAAGATC CGCCACAACA (SEQ ID NO: 313) | 128 |
| 18 | GCAACATCCTGGGGCA CAAGCTGGAGTACA (SEQ ID NO: 314) | ACTACAACAGCCACAACGTCTATA TCATGG (SEQ ID NO: 315) | CCGACAAGCAGAAGAACGGC ATCAAGGTGA (SEQ ID NO: 316) | 107 |
| 20 | TTCAAGGAGGACGGCA ACATCCTGGGGCAC (SEQ ID NO; 317) | AAGCTGGAGTACAACTACAACAGC CACAAC (SEQ ID NO: 318) | GTCTATATCATGGCCGACAA GCAGAAGAAC (SEQ ID NO: 319) | 94 |

TABLE 4

| Guide Index | Left Flank | Target | Right Flank | Target Position |
|---|---|---|---|---|
| 5 | GACCTACGGCGTGCAGTGC TTCAGCCGCTA (SEQ ID NO: 320) | CCCCGACCACATGAAGCAG CACGACTTCTT (SEQ ID NO: 321) | CAAGTCCGCCATGCCCGAA GGCTACGTCCA (SEQ ID NO: 322) | 174 |
| 6 | GACCACCCTGACCTACGGC GTGCAGTGCTT (SEQ ID NO: 323) | CAGCCGCTACCCCGACCAC ATGAAGCAGCA (SEQ ID NO: 324) | CGACTTCTTCAAGTCCGCCA TGCCCGAAGG (SEQ ID NO: 325) | 165 |
| 8 | TTCATCTGCACCACCGGCAA GCTGCCCGTG (SEQ ID NO: 326) | CCCTGGCCCACCCTCGTGAC CACCCTGACC (SEQ ID NO: 327) | TACGGCGTGCAGTGCTTCAG CCGCTACCCC (SEQ ID NO: 328) | 118 |
| 9 | CTTCAGCCGCTACCCCGACC ACATGAAGCA (SEQ ID NO: 329) | GCACGACTTCTTCAAGTCCG CCATGCCCGA (SEQ ID NO: 330) | AGGCTACGTCCAGGAGCGC ACATCTTCTT (SEQ ID NO: 331) | 192 |
| 12 | GGCCCACCCTCGTGACCAC CCTGACCTACG (SEQ ID NO: 332) | GCGTGCAGTGCTTCAGCCG CTACCCCGACC (SEQ ID NO: 333) | ACATGAAGCAGCACGACTT CTTCAAGTCCG (SEQ ID NO: 334) | 152 |
| 13 | CCGCTACCCCGACCACATG AAGCAGCACGA (SEQ ID NO: 335) | CTTCTTCAAGTCCGCCATGC CCGAAGGCTA (SEQ ID NO: 336) | CGTCCAGGAGCGCACCATCT TCTTCAGGA (SEQ ID NO: 337) | 198 |
| 14 | CAAGCTGCCCGTGCCCTGG CCCACCCTCGT (SEQ ID NO: 338) | GACCACCCTGACCTACGGC GTGCAGTGCTT (SEQ ID NO: 339) | CAGCCGCTACCCCGACCAC ATGAAGCAGCA (SEQ ID NO: 340) | 135 |
| 17 | ACCCTCGTGACCACCCTGAC CTACGGCGTG (SEQ ID NO: 341) | CAGTGCTTCAGCCGCTACCC CGACCACATG (SEQ ID NO: 342) | AAGCAGCACGACTTCTTCAA GTCCGCCATG (SEQ ID NO: 343) | 157 |

TABLE 4-continued

| Guide Index | Left Flank | Target | Right Flank | Target Position |
|---|---|---|---|---|
| 19 | ACGGCAAGCTGACCCTGAA GTTCATCTGCA (SEQ ID NO: 344) | CCACCGGCAAGCTGCCCGT GCCCTGGCCCA (SEQ ID NO: 345) | CCCTCGTGACCACCCTGACC TACGGCGTGC (SEQ ID NO: 346) | 157 |
| | | Guides that didn't visibly cut: | | |
| 1 | GACCCTGAAGTTCATCTGCA CCACCGGCAA (SEQ ID NO: 347) | GCTGCCCGTGCCCTGGCCCA CCCTCGTGAC (SEQ ID NO: 348) | CACCCTGACCTACGGCGTGC AGTGCTTCAG (SEQ ID NO: 349) | 108 |
| 2 | GCAGTGCTTCAGCCGCTACC CGACCACAT (SEQ ID NO: 350) | GAAGCAGCACGACTTCTTC AAGTCCGCCAT (SEQ ID NO: 351) | GCCCGAAGGCTACGTCCAG GAGCGCACCAT (SEQ ID NO: 352) | 186 |
| 3 | GCCCTGGCCCACCCTCGTGA CCACCCTGAC (SEQ ID NO: 353) | CTACGGCGTGCAGTGCTTCA GCCGCTACCC (SEQ ID NO: 354) | CGACCACATGAAGCAGCAC GACTTCTTCAA (SEQ ID NO: 355) | 147 |
| 4 | CACCCTGACCTACGGCGTG CAGTGCTTCAG (SEQ ID NO: 356) | CCGCTACCCCGACCACATG AAGCAGCACGA (SEQ ID NO: 357) | CTTCTTCAAGTCCCGCCATG CCCGAAGGCTA (SEQ ID NO: 358) | 168 |
| 7 | ACCACCCTGACCTACGGCG TGCAGTGCTTC (SEQ ID NO: 359) | AGCCGCTACCCCGACCACA TGAAGCAGCAC (SEQ ID NO: 360) | GACTTCTTCAAGTCCGCCAT GCCCGAAGGC (SEQ ID NO: 361) | |
| 10 | GCTACCCCGACCACATGAA GCAGCACGACT (SEQ ID NO: 362) | TCTTCAAGTCCGCCATGCCC GAAGGCTACG (SEQ ID NO: 363) | TCCAGGAGCGCACCATCTTC TTCAAGGACG (SEQ ID NO: 364) | 200 |
| 11 | ATGAAGCAGCACGACTTCT TCAAGTCCGCC (SEQ ID NO: 365) | ATGCCCGAAGGCTACGTCC AGGAGCGCACC (SEQ ID NO: 366) | ATCTTCTTCAAGGACGACGG CAACTACAAG (SEQ ID NO: 367) | 214 |
| 15 | GCACCACCGGCAAGCTGCC CGTGCCCTGGC (SEQ ID NO: 368) | CCACCCTCGTGACCACCCTG ACCTACGGCG (SEQ ID NO: 369) | TGCAGTGCTTCAGCCGCTAC CCCGACCACA (SEQ ID NO: 370) | 125 |
| 16 | TGCACCACCGGCAAGCTGC CCGTGCCCTGG (SEQ ID NO: 371) | CCCACCCTCGTGACCACCCT GACCTACGGC (SEQ ID NO: 372) | GTGCAGTGCTTCAGCCGCTA CCCCGACCAC (SEQ ID NO: 373) | 124 |
| 18 | ACCCTGACCTACGGCGTGC AGTGCTTCAGC (SEQ ID NO: 374) | CGCTACCCCGACCACATGA AGCAGCACGAC (SEQ ID NO: 375) | TTCTTCAAGTCCGCCATGCC CGAAGGCTAC (SEQ ID NO: 376) | 169 |
| 20 | CCACCTACGGCAAGCTGAC CCTGAAGTTCA (SEQ ID NO: 377) | TCTGCACCACCGGCAAGCT GCCCGTGCCCT (SEQ ID NO: 378) | GGCCCACCCTCGTGACCACC CTGACCTACG (SEQ ID NO: 379) | 92 |

From Tables 1, 2, and 3, it appears that if the target sequence is preceeded by a C (i.e. "C" directly 5' of the target sequence) no cleavage of the template occurs. From Tables 1 and 2, it appears that if the target sequence is followed by an "A" (i.e. C directly 3' of the target sequence) cleavage of the template is more likely.

Figure 42A:
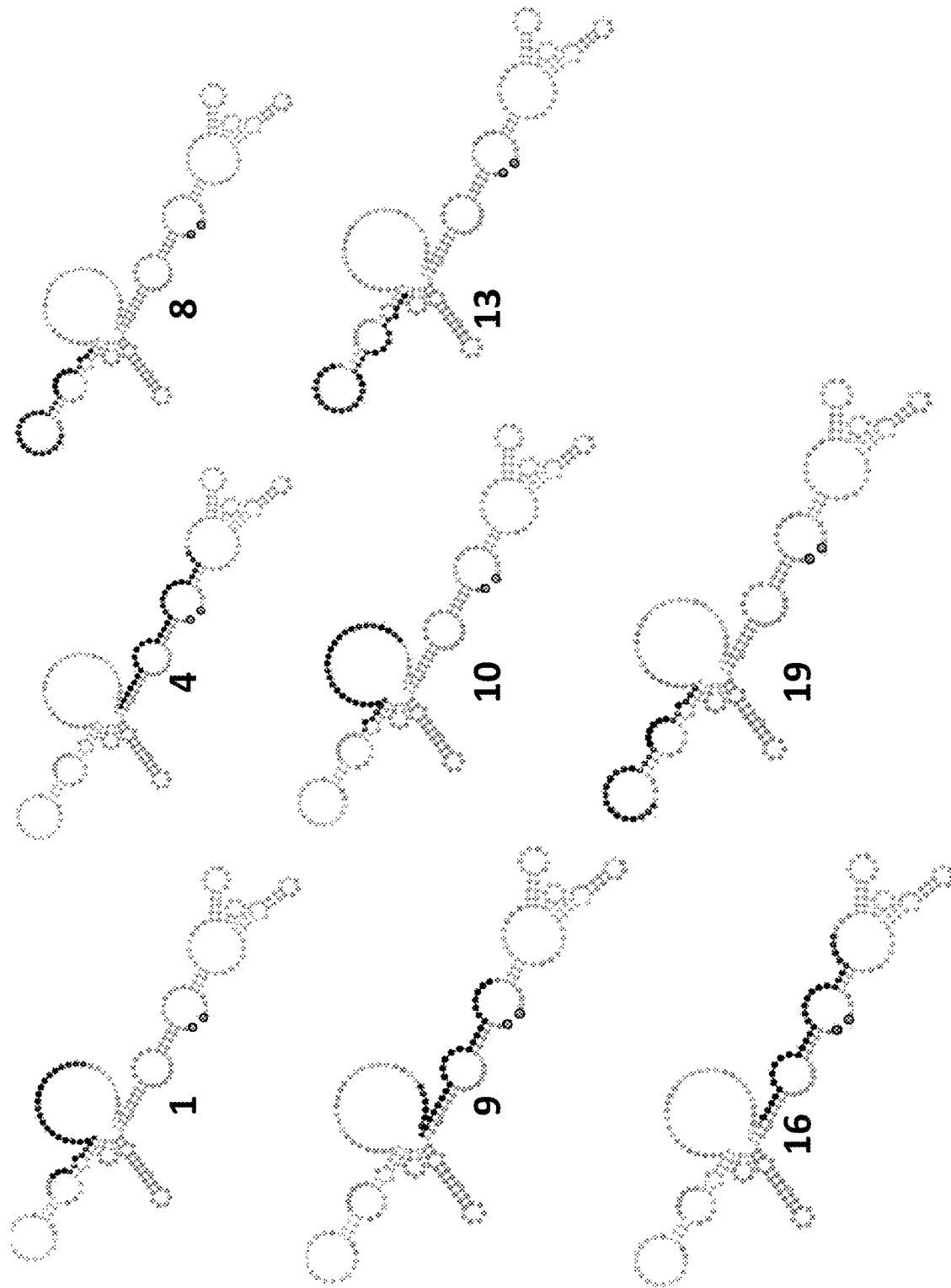
FIGS. 42A and 42B depict computer-simulated secondary structures of EGFP Targets, to determine the effect of secondary structure on cleavage.
Figure 42B:
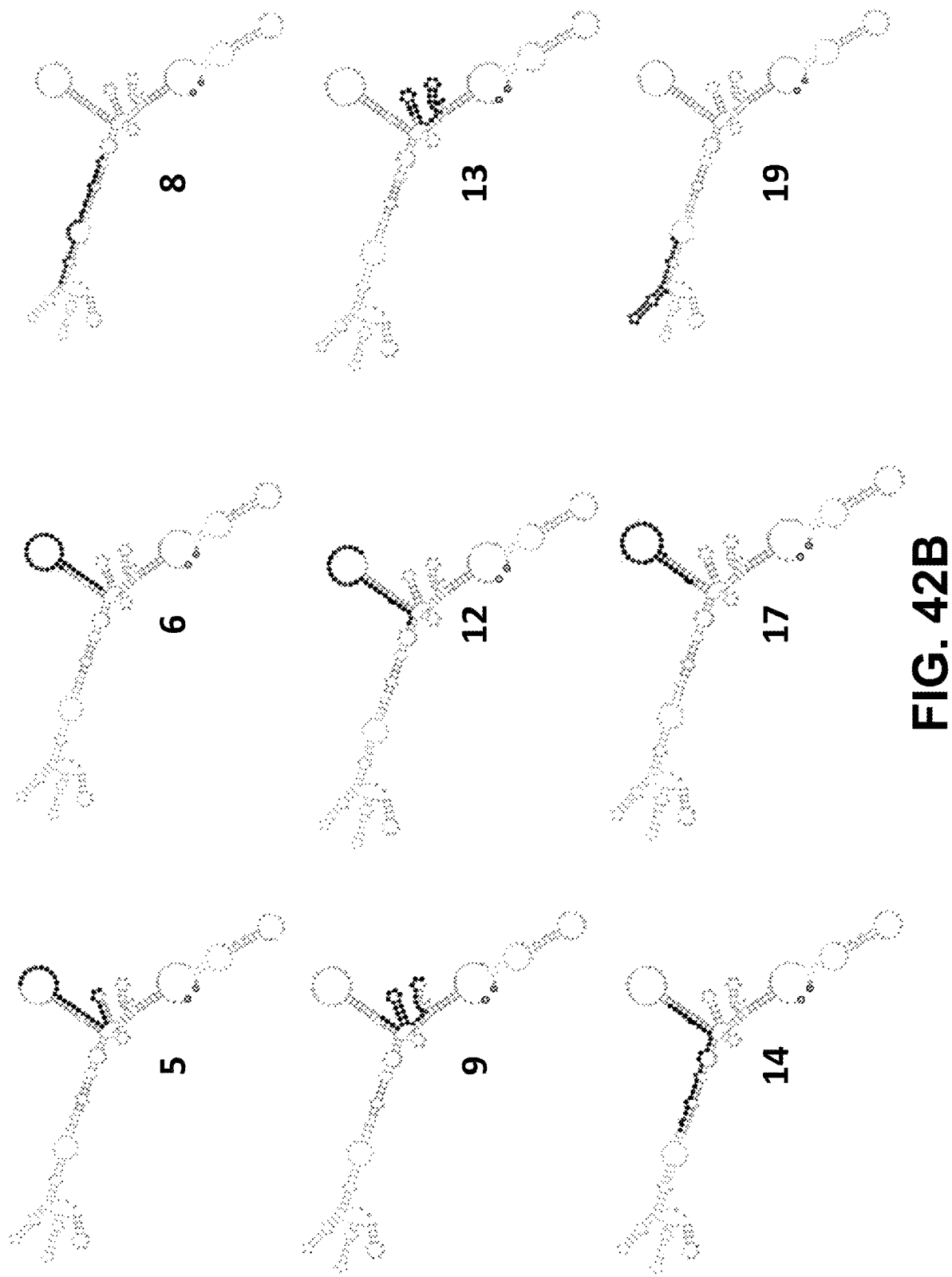
Figure 44:
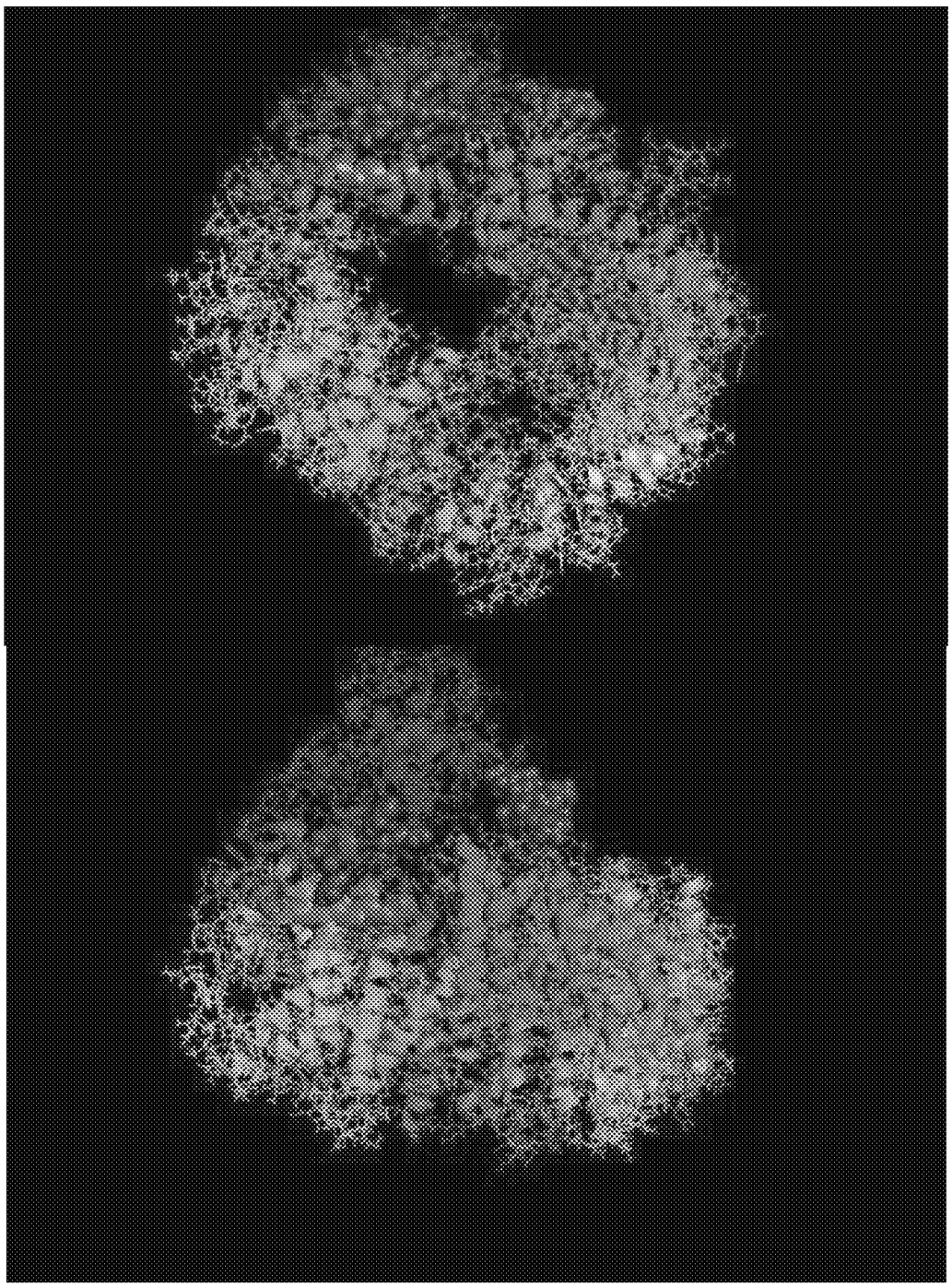
FIG. 44 provides *Bergeyella zoohelcum* group 29 protein structure using PyMOL (a structure software). Blue is the N-Terminus and Red is the C-terminus. Purple dots are the HEPN domains. C-terminus is shown to be free and amenable to linking of functional domains.

FIG. 42 shows the location of the respective guide sequences leading to target cleavage.

Cleavage dependence seems not sequence-specific, nor secondary structure dependent, nor position dependent along the RNA targets.

Similar cleavage intensities for EGFP target 2: #8 and #17, with their first four 5' proximal nucleotides identical and their target positions 39 nucleotides away, give credibility to a 5' proximal cleavage dependence.

Without wishing to be bound by theory, it may be that perhaps RNA cleavage activity may (at least partially) be different from DNA cleavage activity, it that at small scales DNA secondary structure is much more fixed than RNA secondary structure (DNA nearest neighbor thermodynamic model based on stacking energy much more accurate than that of RNA), which is why the presence of a strong or well conserved PAM sequence is preferred for DNA targeting. For RNA targeting, whose secondary structure is much more variable at the small scales relevant to protein interaction, activity may possibly not be (or not only be) dependent on RNA sequence per se, but rather (or also) RNA secondary structure. The following RNA efficiency screen is employed to test this hypothesis. Infect cells with MS2 (or QBeta, which has a larger genome). For a given species of Group 29 protein, design a crRNA library off of which one can prime for NGS. The crRNA library consists of targets that tile the entire RNA viral genome one base pair at a time, and are transformed with the Group 29 protein into the bacteria prior to viral infection. Perform positive selection screen where most efficient targets for cleavage are overrepresented over control crRNA library when harvested from bacterial colonies that survive viral infection. Some areas of viral genome may be more tolerant to cleavage. Given the single base pair resolution of the screen, this tolerance from cleavage efficiency can be spatially deconvolved. Further biophysical computational analysis reveals whether it is sequence or secondary structure that determines efficiency of cleavage. Without wishing to be bound by theory, it may be that perhaps RNA cleavage activity may (at least partially) be different from DNA cleavage activity, it that at small scales DNA secondary structure is much more fixed than RNA secondary structure (DNA nearest neighbor thermodynamic model based on stacking energy much more accurate than that of RNA), which is why the presence of a strong or well conserved.

Example 3: Group 30 Proteins

To learn more about the small proteins, Applicants completed a BLAST protein search. Applicants were interested to see if these small proteins are in other genomes or within other loci. For S2 small proteins, the only other significantly similar proteins were other S2 proteins. For S1, there was one new species *Flavobacterium branchiophilum* (Fb) containing it.

When the Fb small protein was examined, it was found to be next to a large (1,151 aa) protein next to a CRISPR array. The Fb large protein has no homology to other known proteins associated with a CRISPR array. A BLAST search revealed only three known species with this large protein: Fb, *Paludibacter propionicigenes*, and *Bacteroides coprosuis*. Only a small region of homology was seen-a 34aa sequence with homology to a L-lysine-6-monooxygenase.

It seems that the Sla small protein is associated with CRISPR loci that have dual repeat. Applicants will further investigate why there are only three different proteins. This could be a very specific system, a mutated or dead system, or in bacteria types that have little sequencing coverage on NCBI or other databases. Applicants will further investigate the region with homology to L-lysine-6-monooxygenase. Applicants identified 5 proteins in total with significant sequence homology: Fb, Pp, and three Bc protein truncations that were less than 800aa (732, 680, & 370aa). Where an organism is not indicated the sequences are artificial. (SEQ ID Nos.: 380, 382, 384, 386 and 388)

```
BLASTP 2.2.32+
Reference: Stephen F. Altschul, Thomas L. Madden, Alejandro
A. Schaffer, Jinghui Zhang, Zheng Zhang, Webb Miller, and
David J. Lipman (1997), "Gapped BLAST and PSI-BLAST: a new
generation of protein database search programs", Nucleic
Acids Res. 25:3389-3402.

Reference for compositional score matrix adjustment: Stephen
F. Altschul, John C. Wootton, E. Michael Gertz, Richa
Agarwala, Aleksandr Morgulis, Alejandro A. Schaffer, and
Yi-Kuo Yu (2005) "Protein database searches using
compositionally adjusted substitution matrices", FEBS J.
272:5101-5109.

RID: 2ANBZMGK013

Database: All non-redundant GenBank CDS
translations + PDB + SwissProt + PIR + PRF excluding environmental samples
from WGS projects 73,055,898 sequences; 26,613,539,447 total letters
Results of PSI-Blast iteration 1
Query = gi|503850672|ref|WP_014084666.1| hypothetical protein [Flavobacterium
branchiophilum]

Length = 1150

E-value BETTER than threshold
Score  E
Sequences producing significant alignments:                                  (Bits)
Value
ref|WP_014084666.1| hypothetical protein [Flavobacterium bran...             2271
0.0
ref|WP_013446107.1| hypothetical protein [Paludibacter propio...             686
0.0
ref|WP_040310142.1| hypothetical protein [Bacteroides coprosuis]             297
7e-83
gb|EGJ71546.1| hypothetical protein Bcop_1349 [Bacteroides co...             288
5e-80
ref|WP_006744704.1| hypothetical protein [Bacteroides coprosuis]             122
7e-26

ALIGNMENTS
>ref|WP_014084666.1| hypothetical protein [Flavobacterium branchiophilum]
emb|CCB70204.1| Hypothetical protein FBFL15_2182 [Flavobacterium
branchiophilum
FL-15]
Length = 1150
Score = 2271 bits (5884), Expect = 0.0, Method: Compositional matrix
adjust.
Identities = 1150/1150 (100%), Positives = 1150/1150 (100%), Gaps = 0/1150
(0%)

Query     1    MENLNKILDKENEICISKIENTKGIAAPITEKALDNIKSKQKNDLNKEARLHYFSIGHSF    60
               MENLNKILDKENEICISKIENTKGIAAPITEKALDNIKSKQKNDLNKEARLHYFSIGHSF
Sbjct     1    MENLNKILDKENEICISKIENTKGIAAPITEKALDNIKSKQKNDLNKEARLHYFSIGHSF    60
```

```
                -continued
Query    61   KQIDIKKVEDYVLIEELKDEKPLKFITLQKDFFTKEFSIKLQKLINSIRNINNHYVHNFN
 120

KQID KKVEDYVLIEELKDEKPLKFITLQKDFFTKEFSIKLQKLINSIRNINNHYVHN N
Sbjct    61   KQIDTKKVEDYVLIEELKDEKPLKFITLQKDFFTKEFSIKLQKLINSIRNINNHYVHNEN
 120

Query   121   DINLNKIDSNVEHELKESFELAIIEKYYKVNKKYPLDNEIVLFLKELFIKDENTALLNYF
 180

DINLNKIDSNVEHELKESFELAIIEKYYKVNKKYPLDNEIVLFLKELFIKDENTALLNYF
Sbjct   121   DINLNKIDSNVEHELKESFELAIIEKYYKVNKKYPLDNEIVLFLKELFIKDENTALLNYF
 180

Query   181   TNLSKDEAIEYILTFTITENKIWNINNEHNILNIEKGKYLTFEAMLFLITIFLYKNEANH
 240

TNLSKDEAIEYILTFTITENKIWNINNEHNILNIEKGKYLTFEAMLFLITIFLYKNEANH
Sbjct   181   TNLSKDEAIEYILTFTITENKIWNINNEHNILNIEKGKYLTFEAMLFLITIFLYKNEANH
 240

Query   241   LLPKLYDEKNNKSKQELFIFFSKKFTSQDIDAEEGHLIKERDMIQYLNHYPTAWNNDLKL
 300

LLPKLYDEKNNKSKQELFIFFSKKFTSQDIDAEEGHLIK RDMIQYLNHYPTAWNNDLKL
Sbjct   241   LLPKLYDEKNNKSKQELFIFFSKKFTSQDIDAEEGHLIKFRDMIQYLNHYPTAWNNDLKL
 300

Query   301   ESENKNKIMTTKLIDSIIEFELNSNYPSFATDIQFKKEAKAFLFASNKKRNQTSFSNKSY
 360

ESENKNKIMTTKLIDSIIEFELNSNYPSFATDIQFKKEAKAFLFASNKKRNQTSFSNKSY
Sbjct   301   ESENKNKIMTTKLIDSIIEFELNSNYPSFATDIQFKKEAKAFLFASNKKRNQTSFSNKSY
 360

Query   361   NEEIRHNPHIKQYRDEIASALTPISENVKEDKFKIFVKKHVLEEYFPNSIGYEKFLEYND
 420

NEEIRHNPHIKQYRDEIASALTPIS NVKEDKFKIFVKKHVLEEYFPNSIGYEKFLEYND
Sbjct   361   NEEIRHNPHIKQYRDEIASALTPISFNVKEDKFKIFVKKHVLEEYFPNSIGYEKFLEYND
 420

Query   421   FTEKEKEDEGLKLYSNPKINKLIERIDNHKLVKSHGRNQDREMDFSMRFLAENNYFGKDA
 480

FTEKEKEDEGLKLYSNPKINKLIERIDNHKLVKSHGRNQDREMDFSMRFLAENNYFGKDA
Sbjct   421   FTEKEKEDEGLKLYSNPKINKLIERIDNHKLVKSHGRNQDREMDFSMRFLAENNYFGKDA
 480

Query   481   FEKCYKEYDTQEQDEFLQSNENNDDVKFHGKVITYIKYEEHLKNYSYWDCPFVEENNSM
 540

FEKCYKEYDTQEQDEFLQSNENNDDVKFHGKVITYIKYEEHLKNYSYWDCPFVEENNSM
Sbjct   481   FEKCYKEYDTQEQDEFLQSNENNDDVKFHGKVITYIKYEEHLKNYSYWDCPFVEENNSM
 540

Query   541   SVKISIGSEEKILKIQRNLMIYFLENALYNENVENQGYKLVNNYYRELKKDVEESIASLD
 600

SVKISIGSEEKILKIQRNLMIYFLENALYNENVENQGYKLVNNYYRELKKDVEESIASLD
Sbjct   541   SVKISIGSEEKILKIQRNLMIYFLENALYNENVENQGYKLVNNYYRELKKDVEESIASLD
 600

Query   601   LIKSNPDFKSKYKKILPKRLLHNYAPAKQDKAPENAFETLLKKADFREEQYKKLLKKAEH
 660

LIKSNPDFKSKYKKILPKRLLHNYAPAKQDKAPENAFETLLKKADFREEQYKKLLKKAEH
Sbjct   601   LIKSNPDFKSKYKKILPKRLLHNYAPAKQDKAPENAFETLLKKADFREEQYKKLLKKAEH
 660

Query   661   EKNKEDEVKRNKGKQFKLHFIRKACQMMYEKEKYNTLKEGNAAFEKKDPVIEKRKNKEHE
 720

EKNKEDEVKRNKGKQFKLHFIRKACQMMYEKEKYNTLKEGNAAFEKKDPVIEKRKNKEHE
Sbjct   661   EKNKEDEVKRNKGKQFKLHFIRKACQMMYEKEKYNTLKEGNAAFEKKDPVIEKRKNKEHE
 720

Query   721   FGHHKNLNITREEENDYCKWMFAENGNDSYKKYLRDLFSEKHFEDNQEYKNLFESSVNLE
 780

FGHHKNLNITREEENDYCKWMFAENGNDSYKKYLRDLFSEKHFEDNQEYKNLFESSVNLE
Sbjct   721   FGHHKNLNITREEENDYCKWMFAENGNDSYKKYLRDLFSEKHFEDNQEYKNLFESSVNLE
 780

Query   781   AFYAKTKELFKKWIETNKPINNENRYTLENYKNLILQKQVFINVYHFSKYLIDKNLLNSE
 840

AFYAKTKELFKKWIETNKPINNENRYTLENYKNLILQKQVFINVYHFSKYLIDKNLLNSE
Sbjct   781   AFYAKTKELFKKWIETNKPINNENRYTLENYKNLILQKQVFINVYHFSKYLIDKNLLNSE
 840

Query   841   NNVIQYKSLENVEYLISDFYFQSKLSIDQYKTCGKLENKLKSNKLEDCLLYEIAYNYIDK
 900

NNVIQYKSLENVEYLISDFYFQSKLSIDQYKTCGKLENKLKSNKLEDCLLYEIAYNYIDK
```

```
Sbjct      841    NNVIQYKSLENVEYLISDFYFQSKLSIDQYKTCGKLENKLKSNKLEDCLLYEIAYNYIDK
900

Query      901    KNVHKIDIQKILTSKIILTINDANTPYKISVPFNKLERYTEMIAIKNQNNLKARFLIDLP
960
                  KNVHKIDIQKILTSKIILTINDANTPYKISVPFNKLERYTEMIAIKNQNNLKARFLIDLP
Sbjct      901    KNVHKIDIQKILTSKIILTINDANTPYKISVPFNKLERYTEMIAIKNQNNLKARFLIDLP
960

Query      961    LYLSKNKIKKGKDSAGYEIIIKNDLEIEDINTINNKIINDSVKFTEVLMELEKYFILKDK
1020
                  LYLSKNKIKKGKDSAGYEIIIKNDLEIEDINTINNKIINDSVKFTEVLMELEKYFILKDK
Sbjct      961    LYLSKNKIKKGKDSAGYEIIIKNDLEIEDINTINNKIINDSVKFTEVLMELEKYFILKDK
1020

Query      1021   CILSKNYIDNSEIPSLKQESKVWIKENENEIINYRNIACHFHLPLLETEDNLLLNVEQKF
1080
                  CILSKNYIDNSEIPSLKQESKVWIKENENEIINYRNIACHFHLPLLETEDNLLLNVEQKF
Sbjct      1021   CILSKNYIDNSEIPSLKQESKVWIKENENEIINYRNIACHFHLPLLETEDNLLLNVEQKF
1080

Query      1081   IKEELQNVSTINDLSKPQEYLILLFIKEKHNNFYLNLENKNESKTIKNDKEVKKNRVLQK
1140
                  IKEELQNVSTINDLSKPQEYLILLFIKEKHNNFYLNLENKNESKTIKNDKEVKKNRVLQK
Sbjct      1081   IKEELQNVSTINDLSKPQEYLILLFIKEKHNNFYLNLENKNESKTIKNDKEVKKNRVLQK
1140

Query      1141   FINQVILKKK                                                     1150
                  FINQVILKKK
Sbjct      1141   FINQVILKKK                                                     1150

>ref|WP_013446107.1| hypothetical protein [Paludibacter propionicigenes]
gb|ADQ80738.11| hypothetical protein Palpr_2606 [Paludibacter propionicigenes
WB4] (SEQ ID NO: 383)
Length = 1154
Score = 686 bits (1769), Expect = 0.0, Method: Compositional matrix adjust.
Identities = 465/1202 (39%), Positives = 685/1202 (57%), Gaps = 135/1202
(11%)

Query      18     KIENTKGIAAPITEKALDNIKSKQKNDLNKEARLHYFSIGHSFKQIDTKKVEDYVLIEEL    77
                  KIF++KG API EK+  N  K +ND+NKE R+HYF++GH+FKQ+DT+  +F+YVL E L
Sbjct      18     KIFDSKGAIAPIAEKSCRNEDIKAQNDVNKEQRIHYFAVGHTFKQLDTENLFEYVLDENL    77

Query      78     KDEKPLKFITLQKDFFTKEFSIKLQKLINSIRNINNHYVHNENDINLNKIDSNVFHFLKE
137
                  + ++P FI+LQ+  F KEF   +++LI+ IRNIN+HY+H F+ +    +N+   FLKE
Sbjct      78     RAKRPTRFISLQQ--FDKEFIENIKRLISDIRNINSHYIHRFDPLKIDAVPTNIIDELKE
135

Query      138    SFELAIIEKYYK--------VNKKYPLDNEIVLFLKELFIK--DENTALLN---------
178
                  SFELA+I+ Y K           ++  D ++V FL + F +  ++ T++L
Sbjct      136    SFELAVIQIYLKEKGINYLQFSENPHADQKLVAFLHDKFLPLDEKKTSMLQNETPQLKEY
195

Query      179    -----YFTNLSKDEAIEYILTFTITENKIWNINNEHNILNIEKGKYLTFEAMLFLITIFL
233
                       YF LSK AI+ +L   + IWN+ + H +L I GKYL+F  LFL+++FL
Sbjct      196    KEYRKYFKTLSKQAAIDQLLFAEKETDYIWNLFDSHPVLTISAGKYLSFYSCLFLLSMFL
255

Query      234    YKNEANHLLPKLYDFKNN-----KSKQELFTFFSKKFTSQDIDAEEGHLIKFRDMIQYLN
288
                  YK+EAN L+ K+  FK N     KSK+E+FTFFSK+F S DID+EE  L+KFRD+I YLN
Sbjct      256    YKSEANQLISKIKGFKKNTTEEEKSKREIFTFFSKRFNSMDIDSEENQLVKFRDLILYLN
315

Query      289    HYPTAWNNDLKLESENKNKIMTTKLIDSIIEFELNSNYP------SFATDIQFKKEAKAF
342
                  HYP AWN DL+L+S  N MT KL   IIE E+N ++P        FAT +++   K
Sbjct      316    HYPVAWNKDLELDSS--NPAMTDKLKSKIIELEINRSFPLYEGNERFATFAKYQIWGKKH
373

Query      343    LFAS-NKKRNQTSFSNK---SYNEEIRHNPHIKQYRDEIASALTPISFNVKEDKFKIFVK
398
                  L   S K+    SF+++   +Y E   +P K  ++A    ++K  +F K
Sbjct      374    LGKSIEKEYINASFTDEEITAYTYETDTCPELKDAHKKLA--------DLKAAK-GLFGK
424

Query      399    KHVLEEYFPNSIGYEKFLEYNDFTEKEKEDFGLKLYSNPKTNKLIERIDNHKLVKSHGRN
458
```

```
                   +   E            +D  +E    L+    NP  +KLI+RI+  +L  S+GRN
Sbjct  425  RKEKNE-------------SDIKKTETSIRELQHEPNPIKDKLIQRIEKNLLTVSYGRN
470

Query  459  QDRFMDFSMRFLAENNYFGKDAFFKCYKFYDTQEQDEFLQSNE------NNDDVKFHKGK
512
            QDRFMDFS RFLAE NYFG+DA FK Y FY T EQ+  L+  E         D +KFH+GK
Sbjct  471  QDRFMDFSARFLAEINYFGQDASFKMYHFYATDEQNSELEKYELPKDKKKYDSLKFHQGK
530

Query  513  VTTYIKYEEHLKNYSYWDCPFVEENNSMSVKISIGSEEKILKIQRNLMIYFLENALY---
569
             +   +I Y+EHLK Y WD  FV ENN++ +K+S   E + IQR L+IY LE+AL
Sbjct  531  LVHFISYKEHLKRYESWDDAFVIENNAIQKLSFDGVENTVTIQRALLIYLLEDALRNIQ
590

Query  570  NENVENQGYKLVNNYYRELKKDV---EESIASLDLIKSNPDFKSKYKKILPKRLLHNYAP
626
            N   EN G +L+  YY  K D+   ++ +   D I+ P K+++KK+LP+RLL NY+P
Sbjct  591  NNTAENAGKQLLQEYYSHNKADLSAFKQILTQQDSIE--PQQKTEFKKLLPRRLLNNYSP
648

Query  627  A-KQDKAPENAFEILLKKADFREEQYKKLLKKAEHEKNKEDFVKRNKGKQFKLHFIRKAC
685
            A   + P  ++  +L+KA    E++Y  L+ KA+ E N +DF+KRNKGKQFKL FIRKA
Sbjct  649  AINHLQTPHSSLPLILEKALLAEKRYCSLVVKAKAEGNYDDFIKRNKGKQFKLQFIRKAW
708

Query  686  QMMYFKEKYNTLKEGNAAFEKKDPVIEKRKNKEHEFGHHKNLNITREEFNDYCKWMFAFN
745
             +MYF+  Y  L+    AA                 GHHK+ +I R+EFND+ ++MFAF
Sbjct  709  NLMYFRNSY--LQNVQAA-----------------GHHKSFHIERDEFNDFSRYMFAFE
748

Query  746  GNDSYKKYLRDLFSEKHFFDNQEYKNLFESSVNLEAFYAKTKELFKKWIETNKP-TNNEN
804
                   YK YL ++F +K FF+N E+K LF S +LE  Y KTK+ F+ W+ +N   TN +
Sbjct  749  ELSQYKYYLNEMFEKKGFFENNEFKILFQSGTSLENLYEKTKQKFEIWLASNTAKTNKPD
808

Query  805  RYTLENYKNLILQKQVFINVYHFSKYLIDKNLLNSE-NNVIQYKSLENVEYLISDFYFQS
863
             Y L NY+     +  FIN+ HF  YL      L ++ N  I Y++L NV+YLI ++Y+
Sbjct  809  NYHLNNYEQQFSNQLFFINLSHFINYLKSIGKLQTDANGQIIYEALNNVQYLIPEYYYTD
868

Query  864  KLSIDQYKTCGKLFNKLKSNKLEDCLLYEIAYNYI--DKKNVHKI--DIQKILTSKIILT
919
            K   + K+ KL+NKLK+ KLED LLYE+A Y  DK    K   I K+LTS +
Sbjct  869  KPERSESKSGNKLYNKLKATKLEDALLYEMACYLKADKQIADKAKHPITKLLTSDVEFN
928

Query  920  IN--DANTPYKISVPFNKLERYTEMIAIKNQNNLK--ARFLIDLPLYLSKNKIKKGKD-S
974
            I  +    Y + VPF K++   +  + KQ +K    FL ++  YL    +K   KD
Sbjct  929  ITNKEGIQLYHLLVPFKKIDAFIGLKMHKEQQDKKHPTSFLANIVNYLE--LVKNDKDIR
986

Query  975  AGYEII----IKNDLEIEDINTINNKIINDSVKFTEVLMELEKYFILKDKCILSK-NYID
1029
                 YE      +K  L +D+  I+    +S+KFT V +ELE+YFI K+   I+  K N ID
Sbjct  987  KTYEAFSTNPVKRTLTYDDLAKIDGHLISKSIKFTNVTLELERYFIFKESLIVKKGNNID
1046

Query  1030 NSEIPSLKQFSKVWIKENENEIINYRNIACHFHLPLLETFDNLLLNVEQKFIKEELQ--N
1087
               I  L+ +    K+NE     RN A HF +P +++D L+ + E  FI E++   +
Sbjct  1047 FKYIKGLRNYYNNEKKKNE----GIRNKAFHFGIPDSKSYDQLIRDAEVMFIANEVKPTH
1102

Query  1088 VSTINDLSKPQEYLILLFIKFKHNNFYLNLFNKNESKTIKNDKEVKKNRVLQKFINQVIL
1147
            +   DL+K        +  ++ HN+++          + +D  K+    QK+    +I
Sbjct  1103 ATKYTDLNKQLHTVCDKLMETVHNDYF----------SKEGDGKKKREAAGQKYFENIIS
1152

Query  1148 KK                                                        1149
                K
Sbjct  1153 AK                                                        1154
```

>ref|WP_040310142.1| hypothetical protein [*Bacteroides coprosuis*]

-continued

Length = 732 (SEQ ID NO: 385)
Score = 297 bits (761), Expect = 7e-83, Method: Compositional matrix adjust.
Identities = 213/668 (32%), Positives = 348/668 (52%), Gaps = 70/668 (10%)

```
Query  451   LVKSHGRNQDRFMDFSMRFLAENNYFGKDAFFKCYKFYDTQEQDEFLQSNENN------D
       504
             L  +R QD+FM ++ R+LAE+NYFG++A FK Y+F  +EQ++++  + N       D
Sbjct  41    LWSKYSRKQDKFMLYASRYLAESNYFGEEAMFKVYQFASNEEQEKYIVEAKQNLPKREYD
       100

Query  505   DVKFHKGKVTTYIKYEEHLKNYSYWDCPFVEENNSMSVKISIGSEEKILKIQRNLMIYFL
       564
             +K+HKG++  Y Y  HL +Y WD PFV ENN++ + I  E  I+ QR L+IYFL
Sbjct  101   KLKYHKGRLVVYKSYHNHLQEYPRWDYPFVVENNAIQIYVKILGEPWIVSIQRRLIIYFL
       160

Query  565   ENALYNENVENQGYKLVNNYYRELKKDVEESIASLDLIKSN---PDFKSKYKKILPKRLL
       621
             E+AL+++ E+ G L+ NY  ++DV +    ++N S    +K+ P++L+
Sbjct  161   EDALFSKKKESNGIALLQNYLPHHQRDVRNGLFVPKTGQTNNLSTKEMSNLRKLFPRKLI
       220

Query  622   HNYAPAKQDKAPENAFETLLKKADFREEQYKKLLKKAEHEKNKEDFVKRNKGKQFKLHFI
       681
             +Y  + +  ++ +L     + +      +K +  +   GK  KL +I
Sbjct  221   QSYL-YEDNTGDMDSPSQVLSDTSINDTE----------KKGTKKILNLRVGKHLKLRYI
       269

Query  682   RKACQMMYFKEKYNTLKEGNAAFEKKDPVIEKRKNKEHEFGHHKNLNITREEFNDYCKWM
       741
             RK   ++YFK+ Y                K+K   GHHK  +IT++EF Y +WM
Sbjct  270   RKVWNLIYFKDIY-------------------KDKAQRMGHHKKFHITKDEFVFYTRWM
       309

Query  742   FAFNGNDSYKKYLRDLFSEKHFFDNQEYKNLFESSVNLEAFYAKTKELFKKWIETN-KPT
       800
             ++F    SYK +L  F +KHFF+N+E+K LF S +++   Y +TK  F  KW   N
Sbjct  310   YSFESIPSYKDHLIQFFIKKHFFNNEEFKELFLNSSSIDELYLQTKRNFIKWSAHNVNSE
       369

Query  801   NNENRYTLENYKNLILQKQVFINVYHFSKYL-IDKNLLNSENNVIQYKSLENVEYLISDF
       859
               E Y+LE+YK   K ++INV HF +L +K + ++N +IQYK+L+N+ YLI  F
Sbjct  370   KKEKTYSLEDYKLFFESKILYINVSHFISFLNQEKVIQKNDNGIIQYKALKNLSYLIKPF
       429

Query  860   YFQSKLSIDQYKTCGKLFNKLKSNKLEDCLLYEIAYNYI-----DKKNVHKIDIQKILTS
       914
             Y++ KL I+ YKT GK+FNKL+S KLEDCLLYEIAY Y+      ++ IQ
Sbjct  430   YYKDKLEIEHYKTYGKVFNKLRSIKLEDCLLYEIAYRYLLNVTPSFPKYKQLIIQSFPKE
       489

Query  915   KIILTINDANT----------PYKISVPFNKLERYTEMIAIKNQNNLKAR----FLIDLP
       960
             K+ L +N +            Y I VPF KL  +I +N + A        + +
Sbjct  490   KVDLLVNAIYSFEIHNKKGAFIYSIQVPFLKLNELVCLIY-RNSTKIAATNKEFLFLQIY
       548

Query  961   LYLSKNKIKKGKDSAGYEIIIK-NDLEI---EDINTINNKIINDSVKFTEVLMELEKYFI
       1016
             YL      K D  Y+  KN L++   +D+     I+   ++T++L +LEK+I
Sbjct  549   KYLVNYCKNKPVDYELYTVCYKFNQLKVLGYDDLLHFLKHIVKRGLQLTQILTQLEKFLI
       608

Query  1017  LKDKCILSKNYIDNSEIPSLKQFSKVWIKENENEIINYRNIACHFHLPLLETFDNLLLNV
       1076
             +K+ +      S+ + SK+      N ++ + R A +F P + + ++L ++
Sbjct  609   IKNNIQIDIQKQGTLNSLSIYECSKM---NNPQKLEDLRIKAINFDIPDTD-YPSILEHI
       664

Query  1077  EQKFIKEE                                                    1084
             E++FI +E
Sbjct  665   EKQFIIKE                                                    672
```

>gb|EGJ71546.1| hypothetical protein Bcop_1349 [*Bacteroides coprosuis* DSM 18011] (SEQ ID NO: 387)
Length = 680
Score = 288 bits (736), Expect = 5e-80, Method: Compositional matrix adjust.
Identities = 208/656 (32%), Positives = 342/656 (52%), Gaps = 70/656 (11%)

-continued

```
Query   463  MDFSMRFLAENNYFGKDAFFKCYKFYDTQEQDEFLQSNENN------DDVKFHKGKVTTY    60
516          M ++ R+LAE+NYFG++A FK Y+F +EQ++++    + N     D +K+HKG++ Y
Sbjct     1  MLYASRYLAESNYFGEEAMFKVYQFASNEEQEKYIVEAKQNLPKREYDKLKYHKGRLVVY Query   517  IKYEEHLKNYSWDCPFVEENNSMSVKISIGSEEKILKIQRNLMIYFLENALYNENVENQ
576              Y  HL+ Y  WD PFV ENN++ + + I   E  I+ IQR L+IYFLE+AL+++  E+
Sbjct    61  KSYHNHLQEYPRWDYPFVVENNAIQIYVKILGEPWIVSIQRRLIIYFLEDALFSKKKESN
120

Query   577  GYKLVNNYYRELKKDVEESIASLDLIKSN---PDFKSKYKKILPKRLLHNYAPAKQDKAP
633            G   L+ NY  ++DV  +     ++N     S +K+ P++L+ +Y   + +
Sbjct   121  GIALLQNYLPHHQRDVRNGLFVFKTGQTNNLSTKEMSNLRKLFPRKLIQSYL-YEDNTGD
179

Query   634  ENAFETLLKKADFREEQYKKLLKKAEHEKNKEDFVKRNKGKQFKLHFIRKACQMMYFKEK
693                 ++  +L   + +        +K +  +    GK KL +IRK   ++YFK+
Sbjct   180  MDSPSQVLSDTSINDTE----------KKGTKKILNLRVGKHLKLRYIRKVWNLIYFKDI
229

Query   694  YNTLKEGNAAFEKKDPVIEKRKNKEHEFGHHKNLNITREEFNDYCKWMFAFNGNDSYKKY
753            Y                   K+K   GHHK +IT++EF  Y +WM++F   SYK +
Sbjct   230  Y-------------------KDKAQRMGHHKKFHITKDEFVFYTRWMYSFESIPSYKDH
269

Query   754  LRDLFSEKHFFDNQEYKNLFESSVNLEAFYAKTKELFKKWIETNKPTNN-ENRYTLENYK
812          L   F +KHFF+N+E+K LF +S +++  Y +TK  F KW    N +    E  Y+LE+YK
Sbjct   270  LIQFFIKKHFFNNEEFKELFLNSSSIDELYLQTKRNFIKWSAHNVNSEKKEKTYSLEDYK
329

Query   813  NLILQKQVFINVYHFSKYL-IDKNLLNSENNVIQYKSLENVEYLISDFYFQSKLSIDQYK
871               K ++INV HF +L  +K +  ++N +IQYK+L+N+ YLI  FY++ KL I+ YK
Sbjct   330  LFFESKILYINVSHFISFLNQEKVIQKNDNGIIQYKALKNLSYLIKPFYYKDKLEIEHYK
389

Query   872  TCGKLFNKLKSNKLEDCLLYEIAYNYI-----DKKNVHKIDIQKILTSKIILTINDANT-
925          T GK+FNKL+S KLEDCLLYEIAY Y+          ++ IQ    K+ L +N   +
Sbjct   390  TYGKVFNKLRSIKLEDCLLYEIAYRYLLNVTPSFPKYKQLIIQSFPKEKVDLLVNAIYSF
449

Query   926  ---------PYKISVPFNKLERYTEMIAIKNQNNLKAR----FLIDLPLYLSKNKIKKGK
972                   Y I VPF KL   +I +N + A    + +      YL  K
Sbjct   450  EIHNKKGAFIYSIQVPFLKLNELVCLIY-RNSTKIAATNKEFLFIQIYKYLVNYCKNKPV
508

Query   973  DSAGYEIIIK-NDLEI---EDINTINNKIINDSVKFTEVLMELEKYFILKDKCILSKNYI
1028         D  Y + K N L++  +D+      I+   ++ T++L +LEK+  I+K+ +
Sbjct   509  DYELYTVCYKFNQLKVLGYDDLLHFLKHIVKRGLQLTQILTQLEKFLIIKNNIQIDIQKQ
568

Query  1029  DNSEIPSLKQFSKVWIKENENEIINYRNIACHFHLPLLETFDNLLLNVEQKFIKEE     1084
             S+ + SK+     N ++ + R A +F +P + + ++L ++E++FI +E
Sbjct   569  GTLNSLSIYECSKM---NNPQKLEDLRIKAINFDIPDTD-YPSILEHIEKQFIIKE     620
```

>ref|WP_006744704.1| hypothetical protein [*Bacteroides coprosuis*]
gb|EGJ71547.1| hypothetical protein Bcop_1350 [*Bacteroides coprosuis* DSM 18011] (SEQ ID NO: 389)
Length = 370
Score = 122 bits (305), Expect = 7e-26, Method: Compositional matrix adjust.
Identities = 101/328 (31%), Positives = 170/328 (52%), Gaps = 30/328 (9%)

```
Query    23  KGIAAPITEKALDNIK-----SKQKNDLNKEA--RLHYFSIGHSFKQIDTKKVFDYVLIE    75
             KG+ AP++E A N +     +++ DL+ A   ++ FSIG +FK   +K++F+Y L +
Sbjct    18  KGLLAPLSEIAYRNFELVCDNNEKSGDLSLQAISSIYQFSIGQTFKSHNIKQLFNYQLND    77

Query    76  ELKDEKPLKFITLQK-DFFTKEFSIKLQKLINSIRNINNHYVHNFNDINL--NKIDSNVF    132
             E     P K+++LQK F   E+  L  KL+++IR N +Y HN   + NI +
Sbjct    78  EKDRFVPTKYLSLQKKQFIDNEIASTLLKLVSAIRELNQNYTHNLEPLRIGNNIITPQII    137

Query   133  HFLKESFELAIIEKYYKVNK-------KYPLDNEIVL---FLKELFIKDEN--TALLNYF   180
```

-continued

```
                 FL + FE++II    K  K       +Y   D+   +L     F+   LF  + +    T    +
Sbjct    138     EFLHDLFEVSIIMLLNKSVKDRNNFTSQYNEDSLNLLLKEFILTLFFPETSYTTEEIEVL          197

Query    181     TNLSKDEAIEYILTFTITENKIWNINNEHNILNIEKGKYLTFEAMLFLITIFLYKNEANH          240
                   SKDE I  +L F  +       W   +N    ++ I+ GKYL+F + LF+ ++FL+K +
Sbjct    198     RKKSKDELINEVLFFDVQSVYQWKVVNNPLMMPIQCGKYLSFTSCLFINSLFLFKEDTKI          257

Query    241     LLPKLYDFKNNKSK-----QELFTFFSKKFTSQDIDAEEGHLIKFRDMIQYLNHYPTAWN          295
                  + P  + F  NK+    Q     F+   F+  +T   I  ++  + K +D+I+YLN YP+ W
Sbjct    258     IFPN-FPFLKNKTDETQVLQMFFSLFANPYTLHYIPSQHLRIAKHKDIIEYLNLYPSPWQ          316

Query    296     NDLKLESENKNKIMTTKLIDSIIEFELN                                         323
                      L    S++   M+    L D +IE E N
Sbjct    317     E--ALNSQSPCFPMSHLLKDFLIERECN                                         342

Database: All non-redundant GenBank CDS translations + PDB + SwissProt + PIR + PRF
excluding environmental samples from WGS projects
Posted date: Oct. 11, 2015 2:03 PM
Number of letters in database: 26,613,539,447
Number of sequences in database: 73,055,898

Lambda                    K              H
0.317                     0.135          0.383
Gapped
Lambda                    K              H
0.267                     0.0410         0.140
Matrix: BLOSUM62

Gap Penalties: Existence: 11, Extension: 1
Number of Sequences: 73055898
Number of Hits to DB: 2969008310
Number of extensions: 138028101
Number of successful extensions: 489804
Number of sequences better than 100: 2601
Number of HSP's better than 100 without gapping: 0
Number of HSP's gapped: 487533
Number of HSP's successfully gapped: 2931
Length of query: 1150
Length of database: 26613539447
Length adjustment: 162
Effective length of query: 988
Effective length of database: 14778483971
Effective search space: 14601142163348
Effective search space used: 14601142163348
T: 11
A: 40
X1: 16 (7.3 bits)
X2: 38 (14.6 bits)
X3: 64 (24.7 bits)
S1: 41 (20.4 bits)
S2: 85 (37.4 bits)
ka-blk-alpha gapped: 1.9
ka-blk-alpha ungapped: 0.7916
ka-blk-alpha_v gapped: 42.6028
ka-blk-alpha_v ungapped: 4.96466
ka-blk-sigma gapped: 43.6362
```

Example 4: Generation of Group29 Mutants with Enhanced Specificity

Recently a method was described for the generation of Cas9 orthologs with enhanced specificity (Slaymaker et al. 2015). This strategy can be used to enhance the specificity of group29 orthologs. Primay residues for mutagenesis are all positive charges residues within the HEPN domain, since this is the only known structure in the absence of a crystal and we know that specificity mutants in RuvC worked in Cas9. An example of a conserved Arginine residue within HEPN domain is R204.

Additional candidates are positive charged residues that are conserved between different orthologs. These can be used to generate group29 mutants with enhanced specificity.

Example 5: Design of RNA-Guide E. coli Screen and Validation

RNA-guide E. coli screen was designed to determine the likelihood of a guide working against RNA. Targeting guides were identified by tiling along a number of essential genes in E. coli. Specifically, a library of 55,700 targeting guides were created based on 45 essential genes that are unique to their operon. From this, it could be assumed that any knockdown observed was likely due to cis-interference and not trans-interference, which is possible with the collateral effect. Taking the entire coding region, plus nucleotides into the 5' and 3' UTRs, a total of 54,600 unique sites in the E. coli genome were targeted. To establish baseline depletion, eleven hundred (1100) non-targeting guides ("dummy" guides) were also selected by generating randomized 30 nucleotide sequences that did not map to anywhere in the E. coli genome. The relative depletion of these dummy guides was used to determine significant levels of depletion among targeting guides.

Figure 50:
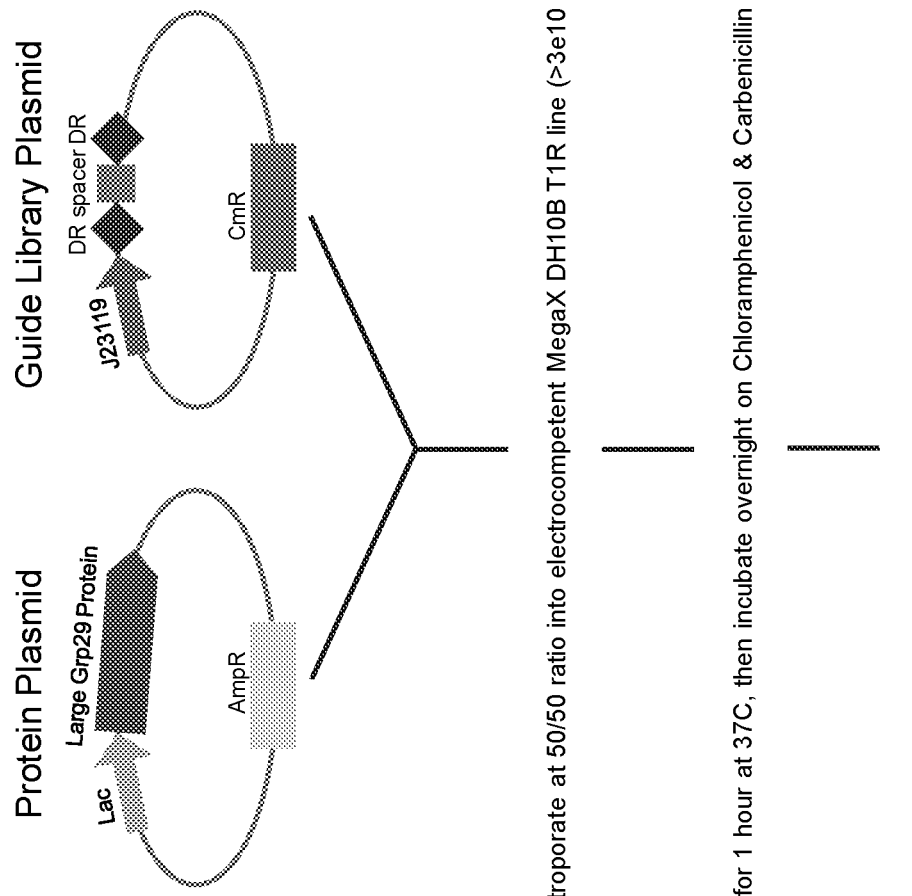
FIG. 50 depicts the experimental design used to create and identify GRP29 effector-dependent depletions of spacer libraries.
Figure 51:
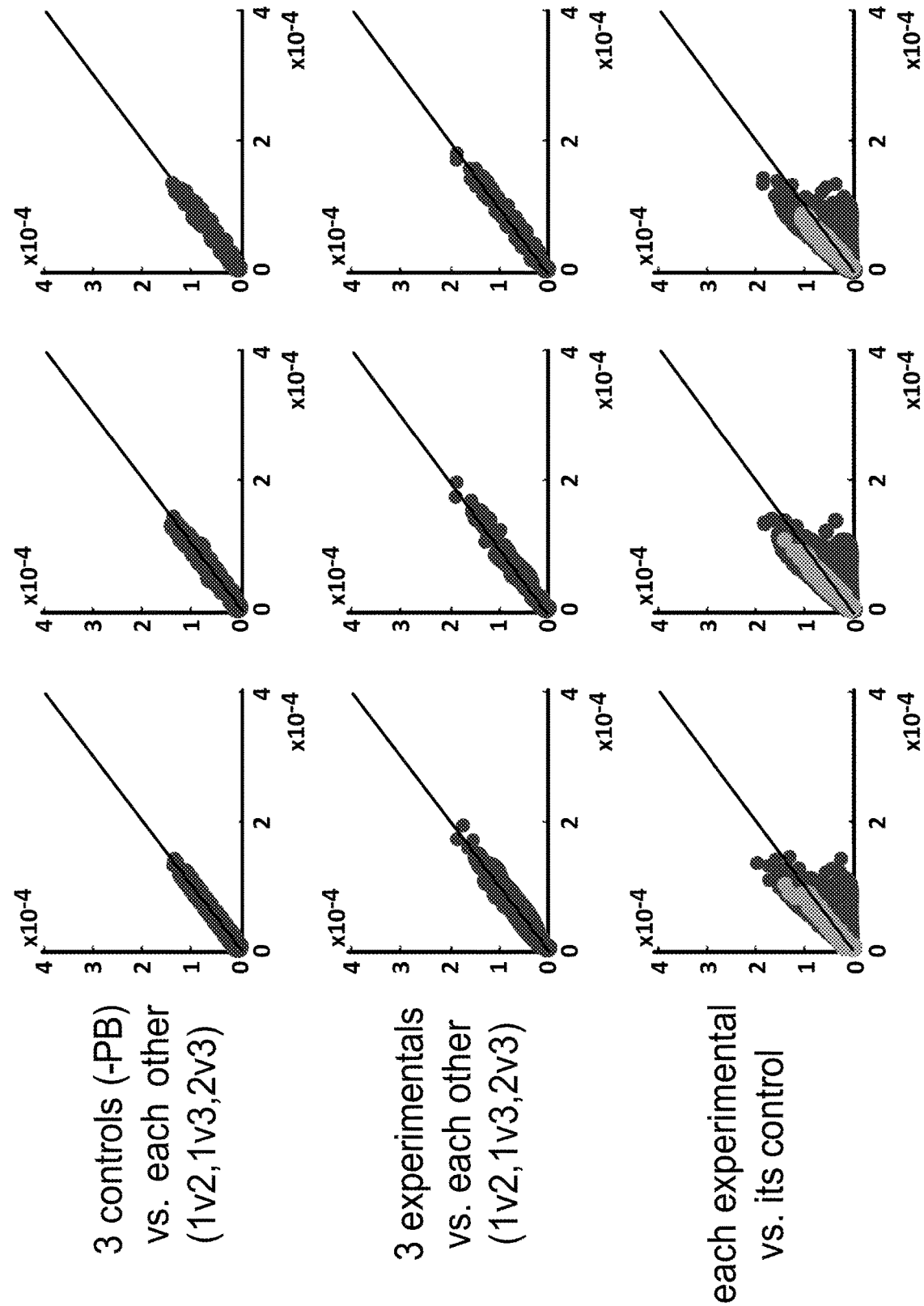
FIG. 51 depicts guide abundance cross-correlations for BZ between spacer libraries in the absence of BZ effector protein (top), among identical experiments (middle), and between experiment and control (bottom).
Figure 52:
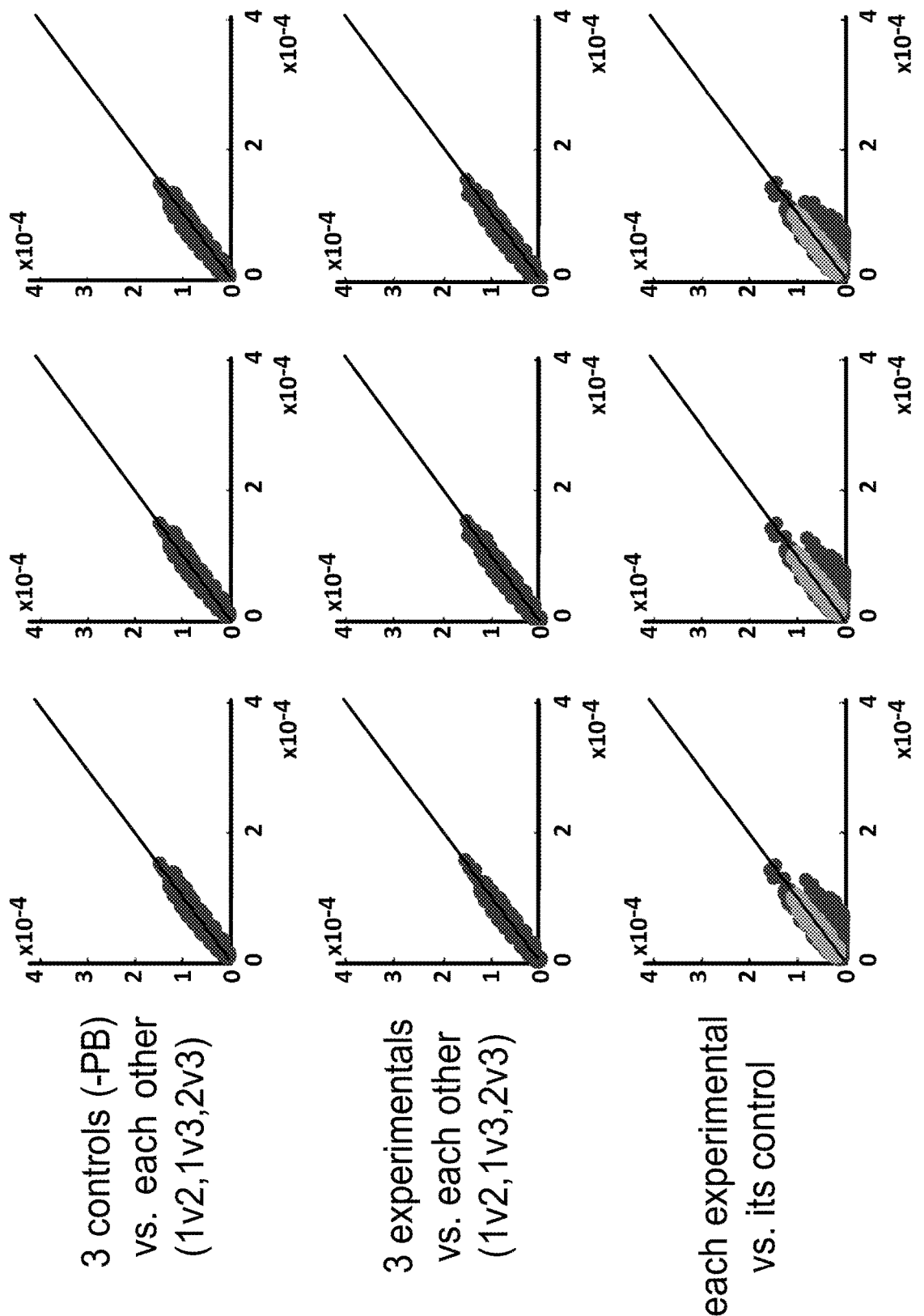
FIG. 52 depicts guide abundance cross-correlations for PB between spacer libraries in the absence of PB effector protein (top), among identical experiments (middle), and between experiment and control (bottom).

As shown in FIG. 50, a protein plasmid and a guide plasmid were prepared, wherein the protein plasmid comprises an RNA-targeting protein, e.g., the large group 29 protein (Large Grp29 Protein), e.g., *Bergeyella zoohelcum* (BZ) or *Prevotella buccae* (PB) protein, or no Cas protein and a first antibiotic resistance gene, e.g., AmpR gene, and the guide plasmid comprises a targeting guide or a non-targeting guide and a second antibiotic resistance gene, e.g., CmR gene. From the library of targeting guides, a guide plasmid library was generated. A protein plasmid and a guide plasmid were co-electroporated at 50/50 ratio and co-introduced into electrocompetent cell, e.g., MegaX DH10B TlR cells. The transformed cells were then allowed to grow for 1 hour at 37° C. and subsequently were incubated overnight on Chloramphenicol and Carbenicillin agar plates. The colonies grown on Chloramphenicol and Carbenicillin agar plates were colletected 11 hours post transformation, and DNA was prepared for sequencing (maxiprep, NGS library prep, and loaded onto NextSeq). The experiment consisted of three bioreps of four plates per condition (control condition, i.e., no Cas protein, and experimental condition, i.e., with BZ or PB). Cross correlations of guide abundances are shown in FIGS. 51 (with BZ) and 52 (with PB).

Figure 53:
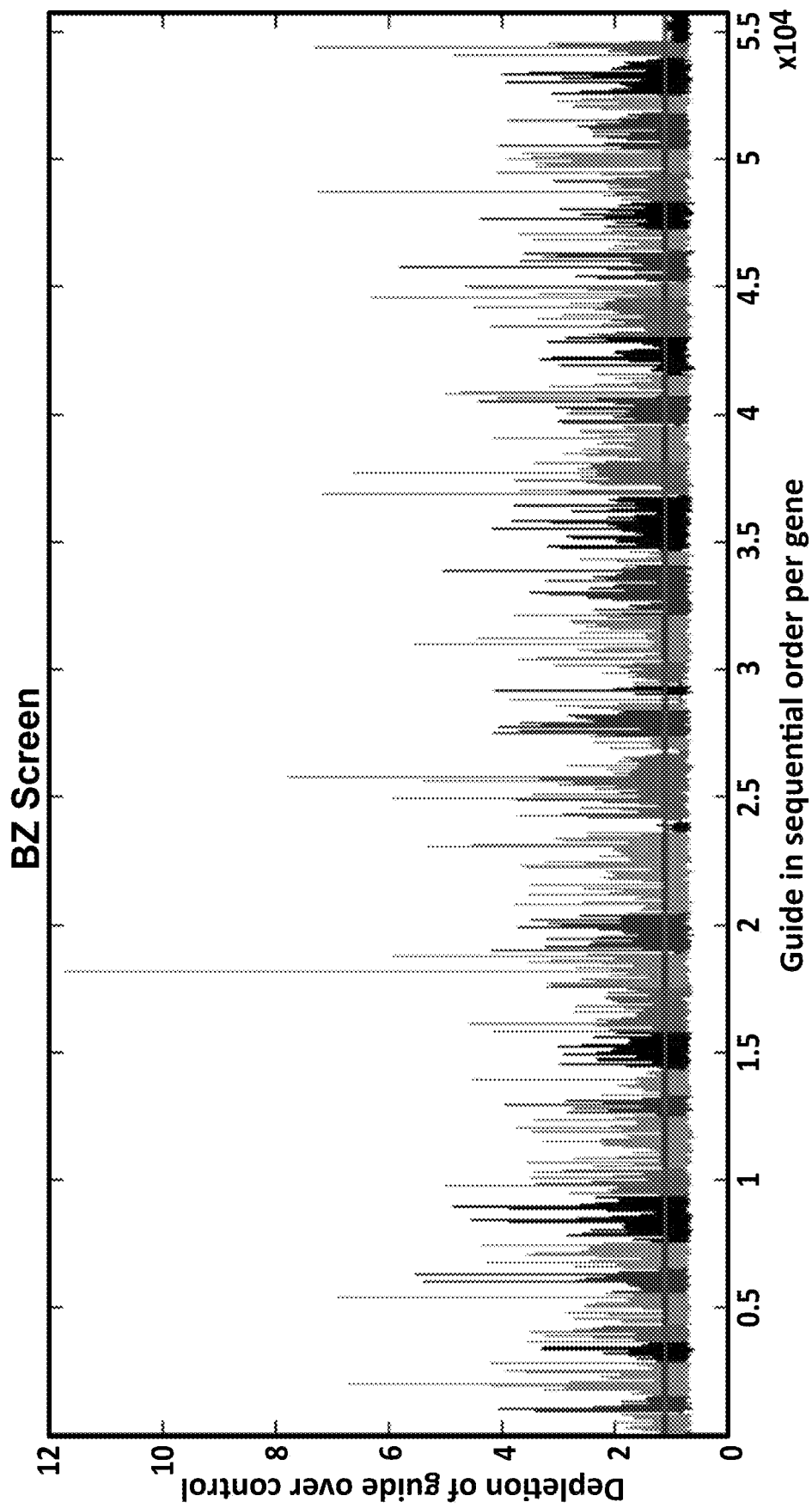
FIG. 53 depicts targeting guide depletions with BZ in alternating colors by gene, non-targeting in black. A red horizontal line indicates the safely depleted line.
Figure 54:
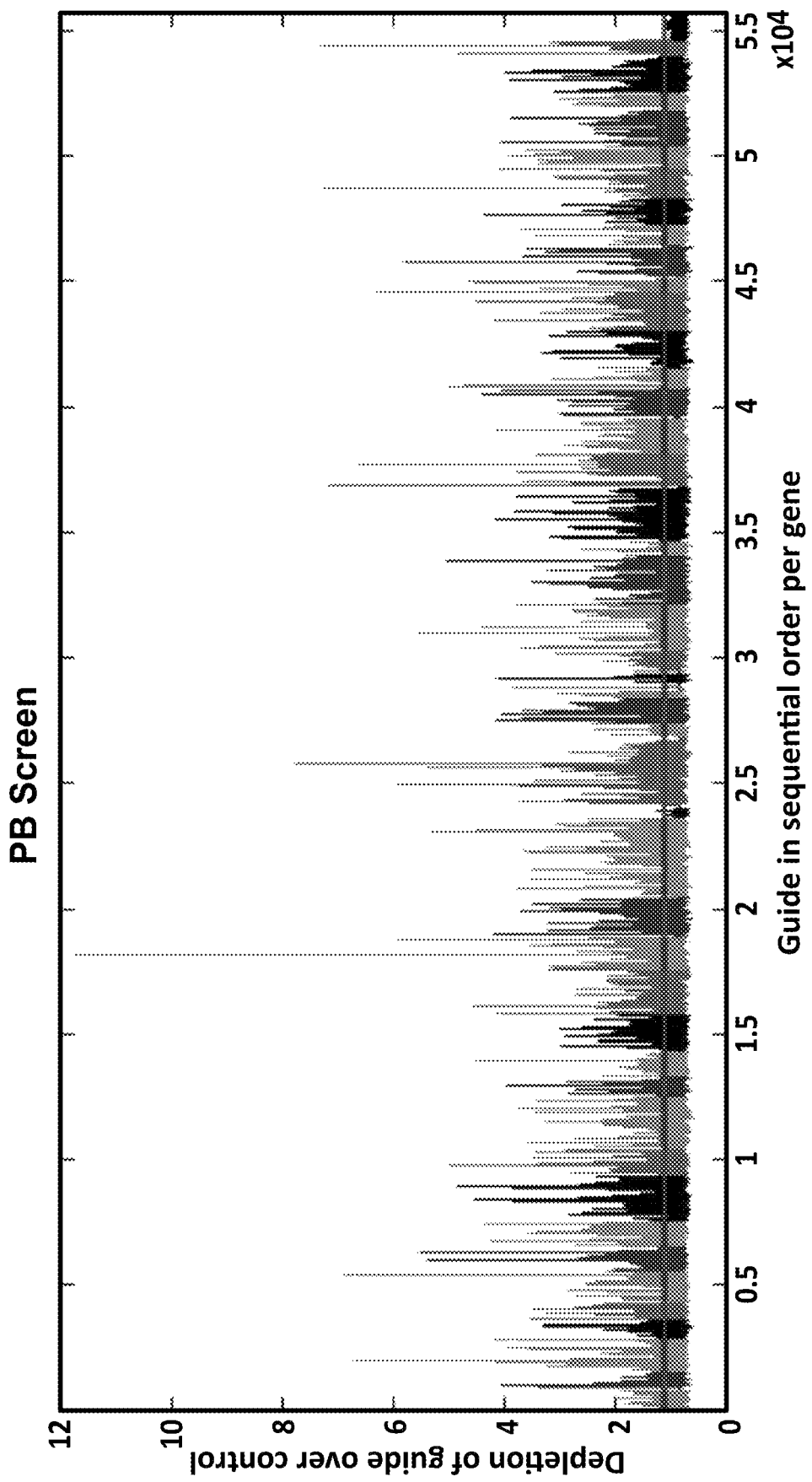
FIG. 54 depicts targeting guide depletions with PB in alternating colors by gene, non-targeting in black. A red horizontal line indicates the safely depleted line.
Figure 55:
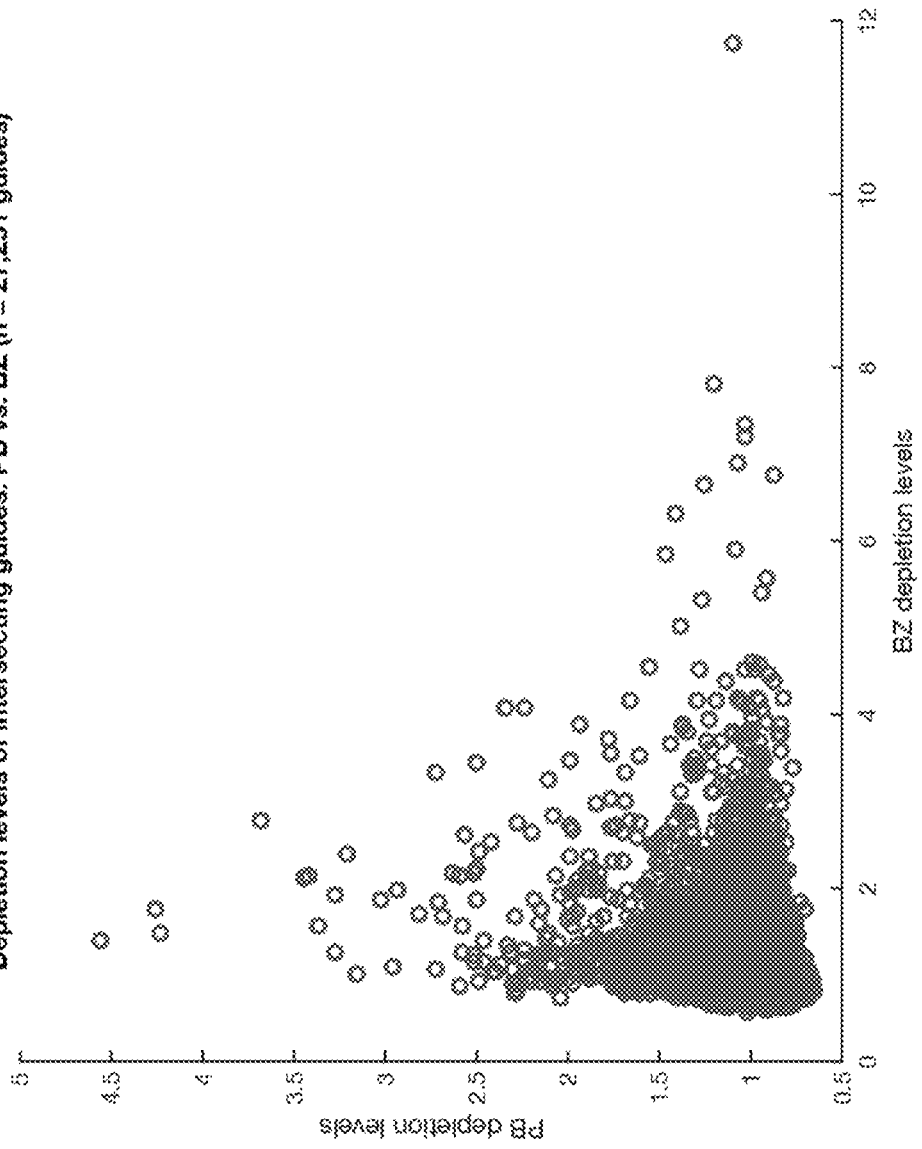
FIG. 55 depicts depletion levels of intersecting guides common to both BZ and PB.
Figure 56:
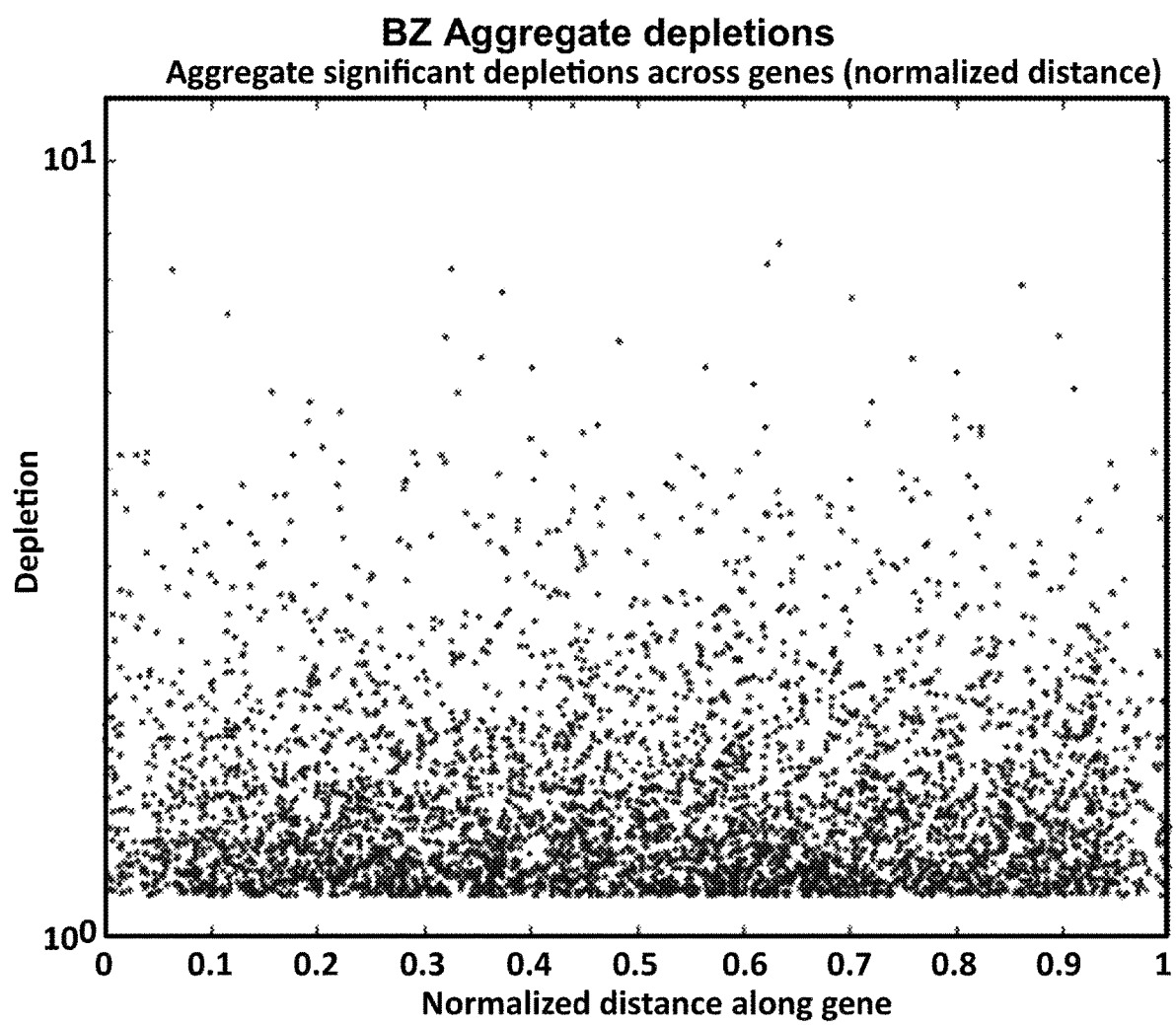
FIG. 56 depicts the aggregate depletion normalized across each gene for BZ.
Figure 57:
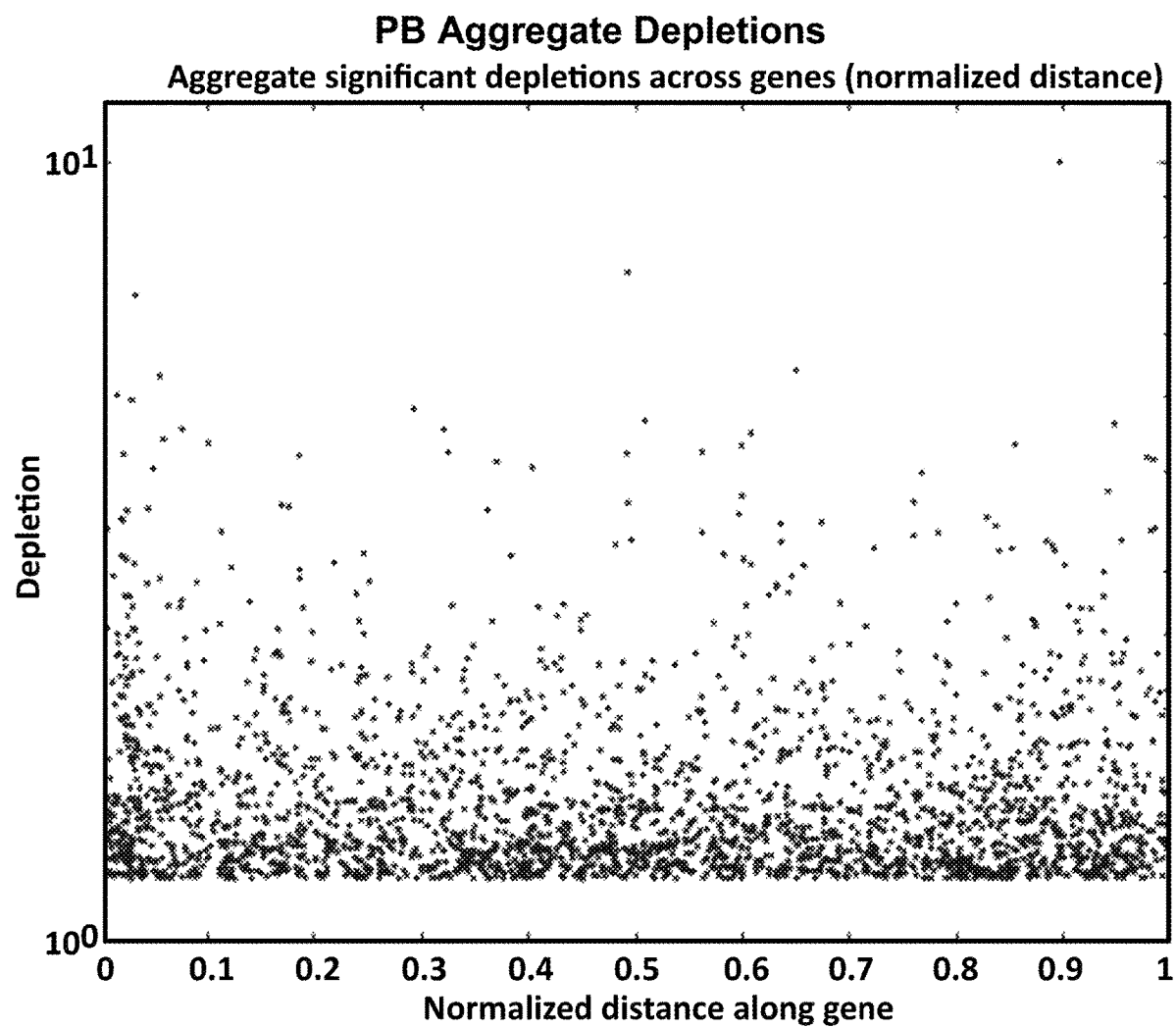
FIG. 57 depicts the aggregate depletion normalized across each gene for PB.

Targeting guide depletions in alternating colors by gene for the 45 essential genes are shown in FIG. 53 for BZ screen and FIG. 54 for PB screen. Red horizontal line represents the safely depleted line, i.e. depletion above the line represents depletion above non-targeting guide. Non-targeting (dummy) guide depletions are shown in black. Depletion levels for targeting guide that are common to both PB and BZ (intersecting guides) are shown in FIG. 55. Normalizing depleted guide efficacy across each gene with both BZ and PB indicated that targeted positions are not spatially biased, as shown in FIGS. 56 (BZ) and 57 (PB).

Figure 58:
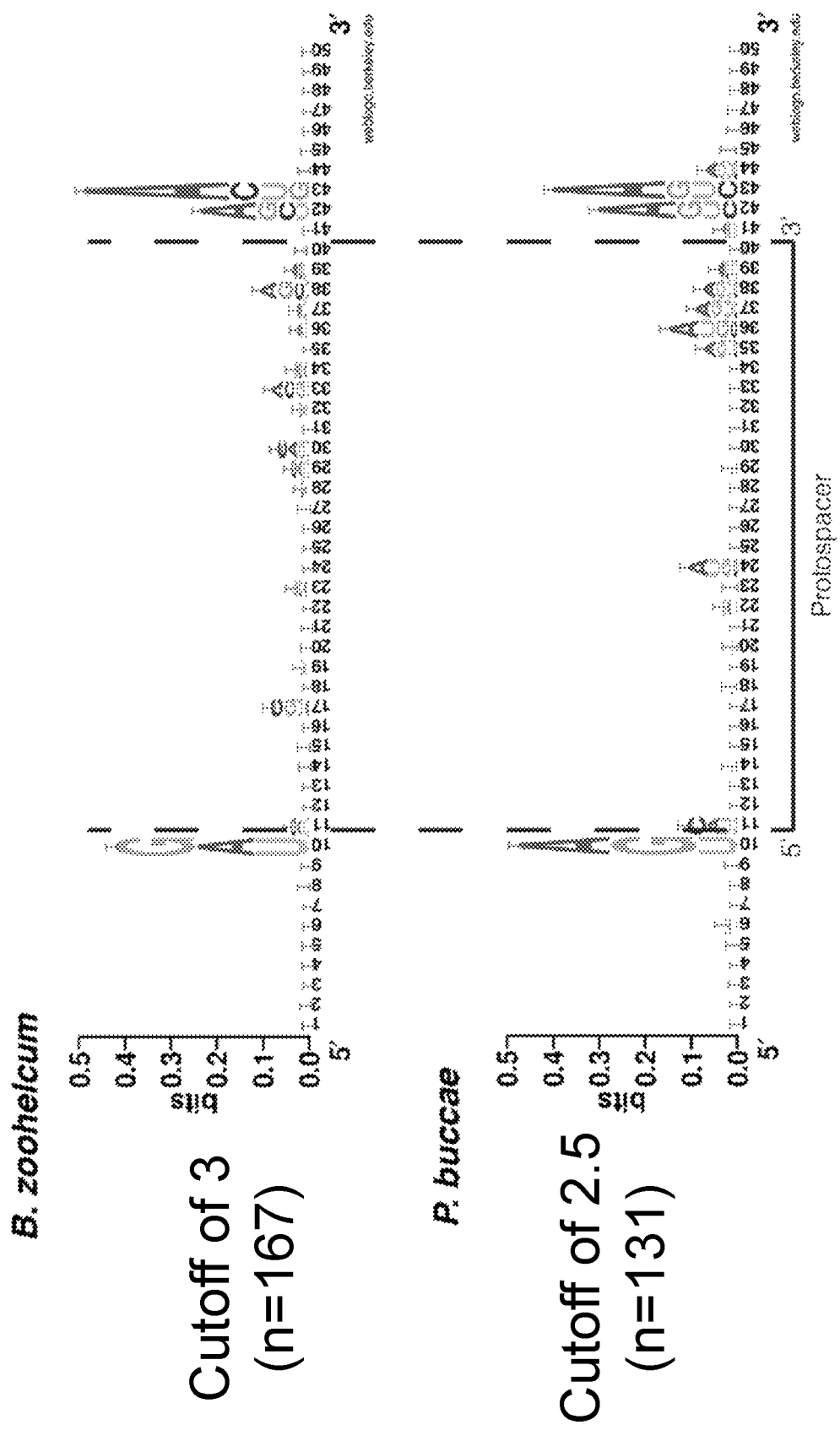
FIG. 58 depicts sequence logos for left protospacer flanking sequence (LPFS) and right protospacer flanking sequence (RPFS) for BZ (top) and PB (bottom).
Figure 59:
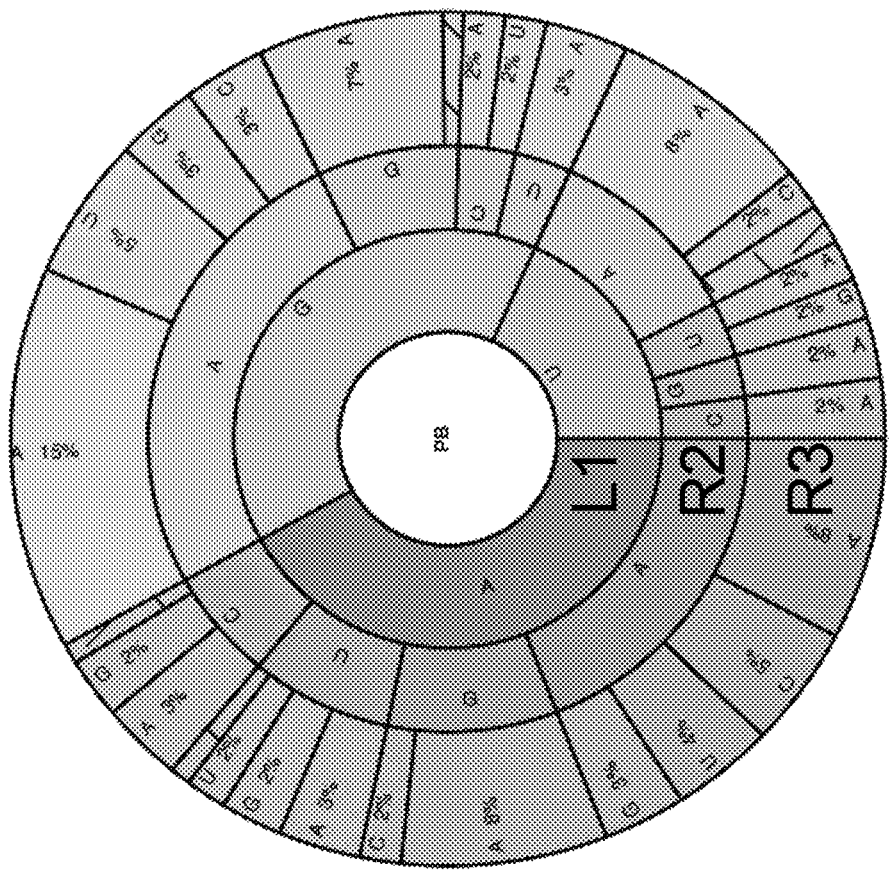
FIG. 59 shows a protospacer flanking sequence (PFS) wheel illustrating nucleotide frequencies for L1, R2, and R3 for BZ.
Figure 60:
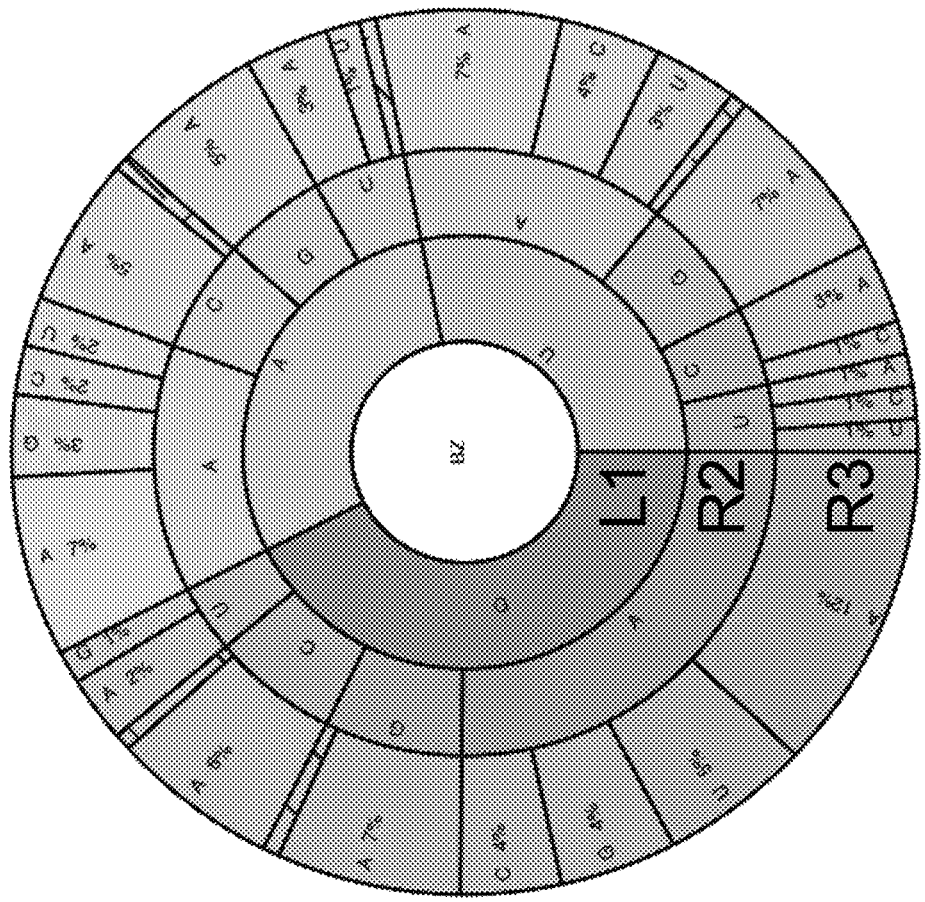
FIG. 60 shows a protospacer flanking sequence (PFS) wheel illustrating nucleotide frequencies for L1, R2, and R3 for PB.
Figure 61:
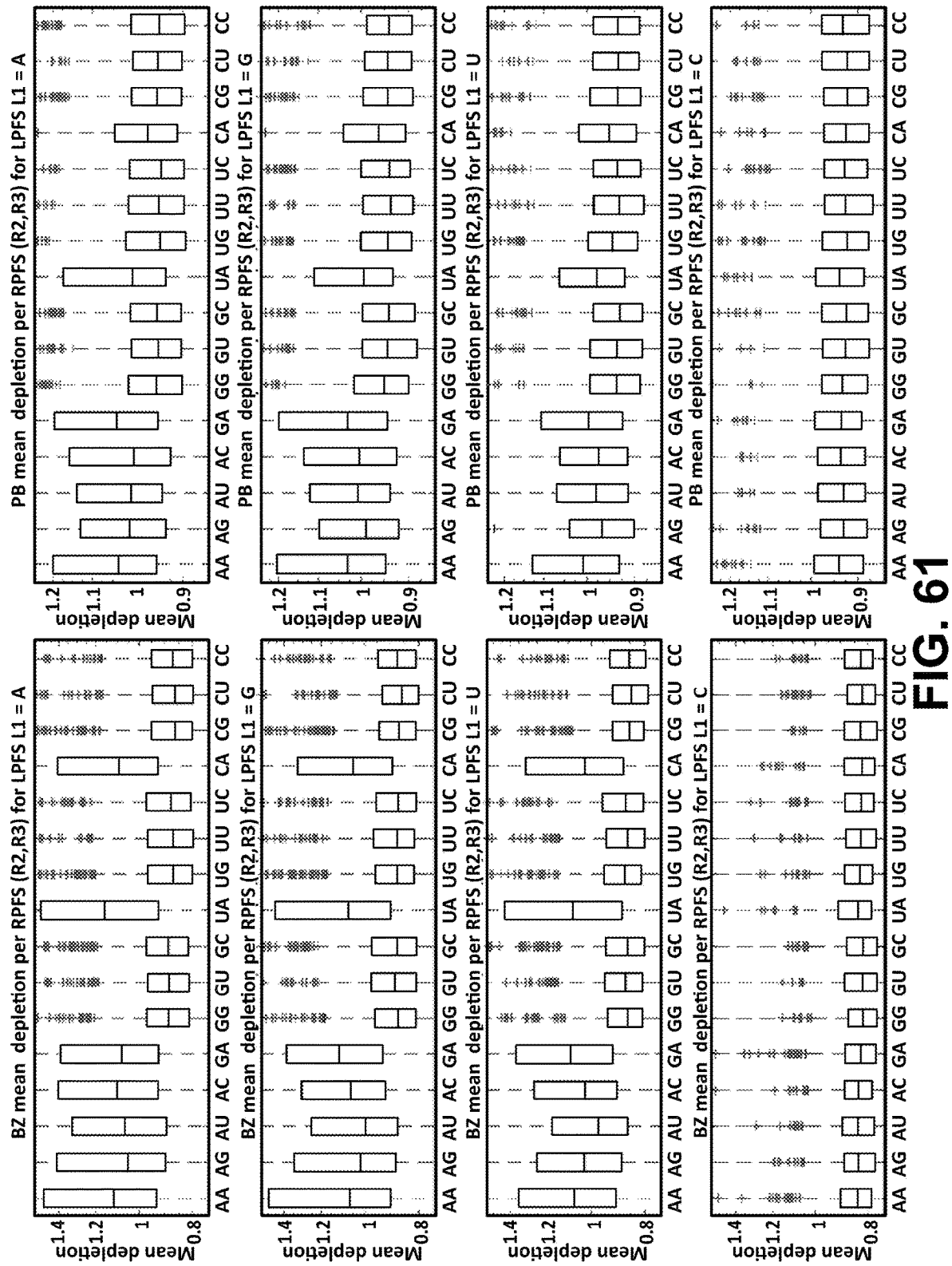
FIG. 61 depicts mean depletions for different combination of nucleotides at L1, R2, and R3. In each panel, L1 is fixed. Left side panels show mean depletions with BZ. Right side panels show depletions with PB.

Sequence logos were created showing the nucleotide frequency for the left protospacer flanking sequence (LPFS) and the right protospacer flanking sequence (RPFS). As shown in FIG. 58, the nucleotide G, A, or U is more preferred at position 10 (L1) with BZ protein. In other words, little or no cleavage was observed when C is at Li. Similarly, PB prefers A, G, or U nucleotide at Li. For the RPFS, cleavage was observed when either A, G, U or C was present at R2 (position 42) or R3 (position 43) with both BZ and PB. FIG. 59 shows the protospacer flanking sequence (PFS) wheel illustrating nucleotide frequencies for L1, R2, and R3 for BZ. FIG. 60 shows a protospacer flanking sequence (PFS) wheel illustrating nucleotide frequencies for L1, R2, and R3 for PB. Mean depletion for RPFS (R2 and R3) at fixed LPFS (L1) is shown in FIG. 61.

Figure 62:
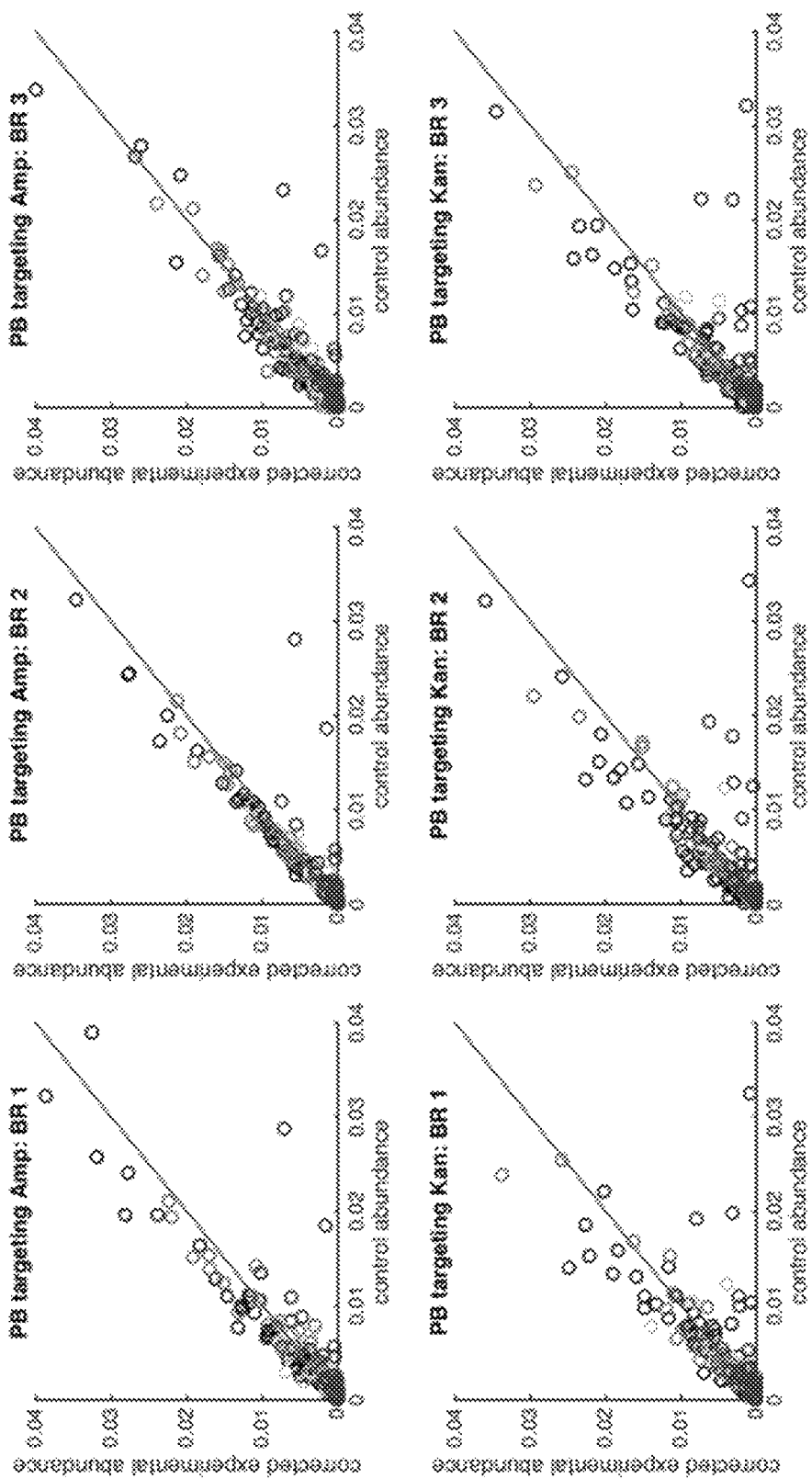
FIG. 62 shows PB targeting of ampicillin and kanamycin resistance genes.
Figure 63:
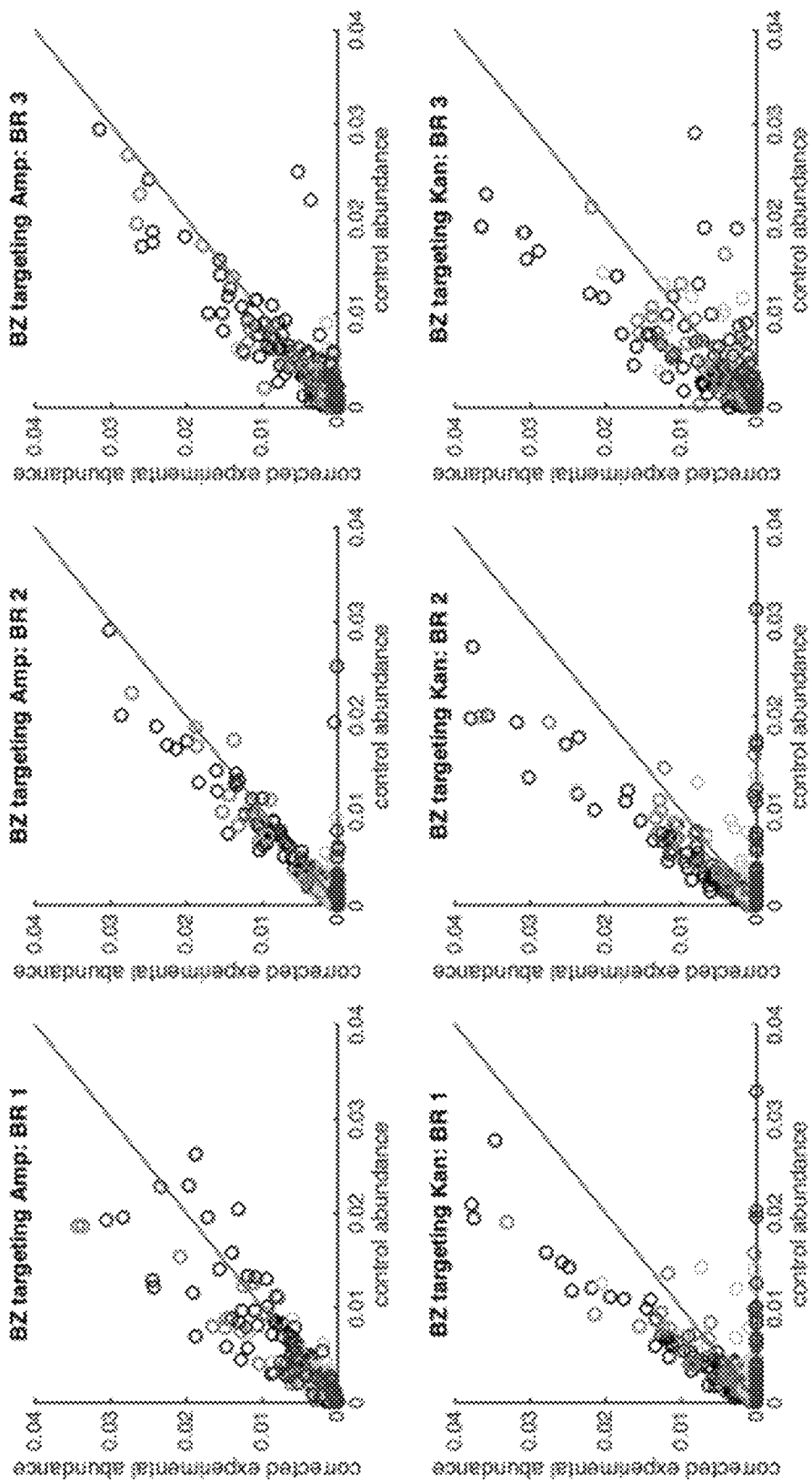
FIG. 63 shows BZ targeting of ampicillin and kanamycin resistance genes.

For validation screen, 4 types of sites in Ampicillin (162 sites)/Kanamycin (162 sites) were selected and a library of 322 sites were generated. Abundance of guides under experimental condition and control condition were deteremined and plotted as shown in FIGS. 62 (PB) and 63 (BZ). Experimental condition represents screening with Cas protein (either BZ or PB) with the libarary and target antibiotic resistance gene, and control condition indicates screening with only library and target antibiotic resistance gene (no Cas protein). Results of validation screens for BZ and PB are shown in FIGS. 62 and 63.

Example 6: Computational Sequence Analysis

From complete compiled Ensembl Release 27 genomes (Yates et al., 2016), CRISPR repeats were identified using PILER-CR (Edgar, 2007). Proteins within 10kb of identified CRISPR arrays were clustered into loci, with loci rejected if more than one protein of size 700 amino acids or larger or if either Cas1 or Cas2 present. For candidate Class 2 effectors, only proteins in these remaining loci of size 900aa to 1800aa were selected. These candidate effectors were subjected to the BLASTP program (Camacho et al., 2008) searched against the NCBI non-redundant (NR) protein sequence database with an E-value cutoff of 1e-7. All discovered proteins were then grouped into putative families via a nearest-neighbor grouping with the same E-value cutoff. Only putative families with at least ten candidate effectors and more than 50% of candidate effectors within 10kb of CRISPR arrays were considered. HHpred (Remmert et al., 2012) and existing CRISPR locus classification rules were used to classify each family, leaving Cas13b as the only unclassified family. Within this family, truncated or suspected partially sequenced effectors were discarded, leaving 105 loci, and 81 with a non-redundant protein. Multiple sequence alignments on these 81 proteins (as well as the accessory Csx27 and Csx28 proteins) were performed using BLOSUM62 (Henikoff and Henikoff, 1992) to identify the HEPN domains and to sort the loci into phylogenetic trees. Vienna RNAfold (Lorenz et al., 2011) was used to predict secondary structure of each direct repeat, whose transcriptional orientation was chosen as identical to that of Cas13b in its locus. CRISPRTarget (Biswas et al., 2013) was used to search the spacers in each locus against NCBI phage and plasmid genomes. Weblogos were generated for all unique direct repeats and protospacer flanking sequences (Crooks et al., 2004). TMHMM Server v. 2.0 (Moller et al., 2001) was used to predict the transmembrane helices in Csx27 and Csx28.

Example 7: RFP-Tagged Protein Fluorescent Imaging

One Shot Stbl3 Chemically Competent *E. coli* were transformed with RFP (negative control) or RFP fused to the N- or C-termini of Csx27 of *Bergeyella zoohelcum* or Csx28 of *Prevotella buccae*. Clones were cultured up in 5 mL of antibiotic LB overnight, then spun down at 5000 g and resuspended in PBS with 1% methanol-free formaldehyde. After 30 minutes fixation, cells were washed once with PBS and then diluted 1:2 in PBS. 5 uL of sample was pipetted onto a silane-coated slide, which was covered with a coverslip. Fluorescent imaging was performed in a 63× objective microscope with oil immersion.

Example 8: Bacterial RNA-Sequencing

RNA was isolated and prepared for sequencing using a previously described protocol (Shmakov et al., 2015; Heidrich et al., 2015). For native *Bergeyella zoohelcum* ATCC 43767 RNA sequencing, we repeated the experiment with a modified protocol, omitting TAP prior to 5' adapter ligation, to promote enrichment of processed transcripts originating from the CRISPR array.

The prepared cDNA libraries were sequenced on a MiSeq (Illumina). Reads from each sample were identified on the basis of their associated barcode and aligned to the appropriate RefSeq reference genome using BWA (Li and Durbin, 2009). Paired-end alignments were used to extract entire transcript sequences using Galaxy (usegalaxy.org), and these sequences were analyzed using Geneious 8.1.8.

Example 9: *E. coli* Essential Gene Experiment

The intersection of two *E. coli* DH10B strain essential gene studies (Gerdes et al., 2003; Baba et al., 2006) was taken, and further pared down to 45 genes by only selecting genes exclusive to their respective operons. Over all genes 54,600 spacers were designed to tile at single resolution across the coding region, as well as to extend 60nt into the 5' UTR and 3'UTR. In addition, 1100 non-targeting, randomly generated spacers with no precise match to the *E. coli* DH10B strain genome were added to the library as a non-targeting negative control. The library of spacers was cloned into a *Bergeyella zoohelcum* or *Prevotella buccae* direct repeat-spacer-direct repeat backbone containing a chloramphenicol resistance gene using Golden Gate Assembly (NEB) with 100 cycles, and then transformed over five 22.7 cm×22.7 cm chloramphenicol LB Agar plates. Libraries of transformants were scraped from plates and DNA extracted using the Macherey-Nagel Nucleobond Xtra Midiprep Kit (Macherey-Nagel). 50 ng of library plasmid and equimolar gene plasmid containing an ampicillin resistance gene (bzcas13b, bzcas13b & bzcsx27, pbcas13b, pbcas13b & pbcsx28, empty vector pBR322) were transformed into MegaX DH10B™ T1R Electrocomp™ Cells (ThermoFisher) according to manufacturer's protocol, with four separate 22.7 cm×22.7 cm carbenicillin-chloramphenicol LB Agar plates per bioreplicate, and three bioreplicates per condition (twelve transformations total per condition). Eleven hours post-transformation, libraries of transformants were scraped from plates and DNA extracted using the Macherey-Nagel Nucleobond Xtra Maxiprep Kit (Macherey-Nagel).

Example 10: *E. coli* Essential Gene Analysis

Prepared DNA libraries were sequenced on a NextSeq (Illumina), with reads mapped to the input library of spacers. Spacer depletions were calculated as the read abundance of a spacer in the empty vector condition divided by read abundance in each gene plasmid condition. Mean depletions over three bioreplicates were calculated, with a maximum coefficient of variation of 0.2 and minimum spacer read abundance of 1/3N, where N=55,700, as a quality-control filter. Weblogos of the strongly depleted (top 1% depleted) spacers were generated (Crooks et al., 2004), and from each identified PFS heatmaps of the ratio of safely depleted (>56 above mean depletion of non-targeting spacers) spacers to all spacers in the screen were generated. For spatial analysis via empirical cumulative distribution functions, safely depleted spacers were aggregated across the first or last 250nt of genes.

For secondary structure analysis, the RNA accessibility model from Vienna RNAplfold (Bernhart et al., 2006) was utilized. RNAplfold calculates through a moving average of RNA folds the probability that a region u of RNA is unpaired given its cis sequence context in a four-parameter model, where W is the moving average window length in nucleotides, L is the maximum permissible pairing distance between nucleotides in the window, and $u_{start}$ and $u_{end}$ are the start and end of the region u, respectively. To apply this model to our data, spacers from the *E. coli* essential gene screen were separated into training/testing cohorts of five or more, each represented by a unique permissible PFS and gene and containing at least one spacer in the top 2% of depleted spacers from the screen (to enhance predictive signal). These cohorts were randomly divided into a training set (~80%) and a testing set (~20%). For optimizing a secondary structure-mediated model of efficient spacer design, the percent of cohorts for which the top spacer is accurately predicted or falls in the top 3 depleted spacers in a cohort were selected as objective functions top 1 and top 3 accuracy. The two objective functions on the training data set were optimized, first by fixing W and L while varying $u_{start}$ and $u_{end}$, then by fixing $u_{start}$ and $u_{end}$ and varying W and L (FIG. 66B). In the case of bzcas13b with bzcsx27, as well as that of bzcas13b alone, the optimized parameters were found to be approximately W=240, L=180, $u_{start}$=16, and $u_{end}$=30. The performance of this RNAplfold model relative to $10^6$ Monte Carlo simulations performed on the testing data set were gauged, and empirical P-values of less than 1e-2 for top 1 accuracy, and less than 1e-5 for top 3 accuracy were found. Similar predictive power applied to pbcas13b with pbcsx28, as well as to pbcas13b alone.

Example 11: Kanamycin Validation Screen Experiment

A total of 160 kanamycin-targeting spacers was selected, 42 of which contain both PFS rules, 47 of which contain one rule, and 71 of which contain no rules, to which 162 non-targeting control spacers were added. The library of spacers was cloned into either a bzcas13b and *Bergeyella zoohelcum* direct repeat-spacer-direct repeat backbone or simply a *Bergeyella zoohelcum* direct repeat-spacer-direct repeat backbone containing a chloramphenicol resistance gene using Golden Gate Assembly (NEB) with 100 cycles, and then transformed over one 22.7 cm×22.7 cm carbenicillin LB Agar plate. The two cloned library plasmids were then re-transformed with over a 22.7 cm×22.7 cm chloramphenicol LB Agar plate or a 22.7 cm×22.7 cm kanamycin-chloramphenicol LB Agar plate. Libraries of transformants were scraped from plates and DNA extracted using the Qiagen Plasmid Plus Maxi Kit (Qiagen). 100 ng of library DNA and 100 ng of pMAX-GFP (Lonza), containing a kanamycin resistance gene were added to 50 uL of chemically competent 10-beta cells (NEB) and transformed according to the manufacturer's protocol.

Example 12: Kanamycin Validation Screen Analysis

Prepared DNA libraries were sequenced on a NextSeq (Illumina), with reads mapped to the input library of spacers. For normalizing the abundance of spacers of two separate clonings, the corrected experimental read abundance of a given spacer was calculated as the read abundance of that spacer in the bzcas13b plasmid (kanamycin-chloramphenicol transformation) multiplied by the ratio of the read abundance ratio of that spacer in the non-bzcas13b plasmid (chloramphenicol-only transformation) to the read abundance ratio of that spacer in the bzcas13b plasmid (chloramphenicol-only transformation).

Example 12: MS2 Phage Drop Plaque Assay

Individual spacers for MS2 interference were ordered as complementary oligonucleotides containing overhangs allowing for directional cloning in between two direct repeat sequences in vectors containing cas13b. 10 uM of each complementary oligo were annealed in 10λ PNK Buffer (NEB), supplemented with 10 mM ATP and 5 units of T4PNK (NEB). Oligos were incubated at 370 C for 30 min., followed by heating to 95° C. for 5 min. and then annealed by cooling to 4° C. Annealed oligos were then diluted 1:100 and incubated with 25 ng of Eco31I digested cas13b vector in the presence of Rapid Ligation Buffer and T7 DNA ligase (Enzymatics). Individual plasmids were prepared using the QIAprep Spin Miniprep Kit (Qiagen), sequence confirmed and then transformed into C3000 (ATCC 15597) cells made competent using the Mix & Go E. co/i Transformation Kit (Zymo). In the case of experiments using csx27 or csx28, C3000 cells harboring these plasmids were made competent and then transformed with cas13b DR-spacer-DR plasmids. Following transformation, individual clones were picked and grown overnight in LB containing the appropriate antibiotics. The following morning, cultures were diluted 1:100 and grown to an $OD_{600}$ of 2.0, then mixed with 4 mL of antibiotic containing Top Agar (10 g/L tryptone, 5 g/L yeast extract, 10 g/L sodium chloride, 5 g/L agar) and poured on to LB-antibiotic base plates. 10 fold serial-dilutions of MS2 phage were made in LB and then spotted onto hardened top agar with a multi-channel pipette. For assessing interference levels in FIG. 4, samples were blinded using a key and the lowest dilution of phage at which plaque formation occurred was compared to pACYC by eye, where the lowest dilution of MS2 that formed plaques on pACYC was set to 1.

Example 13: DNA Targeting

A 34nt target sequence consisting of a 30nt protospacer and a permissive PFS a permissive PFS (5'-G, 3'-AAA) was cloned into pUC19 into two locations. For the transcribed target, the target sequence was cloned into the coding strand of the bla gene, in frame immediately after the start codon, with the G of the start codon serving as the 5' PFS. For the non-transcribed target the identical target sequence (protospacer and PFS) were cloned into the AatII site of pUC19, so that the protospacer appears on the non-transcribed strand with respect to the pBla and pLac promoters. To determine interference, 25 ng of the ampicillin resistant target plasmid and 25 ng of the chloramphenicol resistant bzcas13b or empty vector (pACYC) were added to 5 uL of NovaBlue GigaSingle cells (Novagen). The cells were incubated for 30 minutes on ice, heatshocked for 30 seconds at 42° C. and incubated on ice for 2 minutes. Then, 95 uL of SOC was added to cells and they were incubated with shaking at 370 C for 90 minutes, before plating the entire outgrowth (100 uL) on plates containing both chloramphenicol and ampicillin.

METHODS REFERENCES

1. Baba T, Ara T, Hasegawa M, Takai Y, Okumura Y, Baba M, et al. Construction of *Escherichia coli* K-12 in-frame, single-gene knockout mutants: the Keio collection. Molecular systems biology. 2006; 2:2006 0008. doi: 10.1038/msb4100050. PubMed PMID: 16738554; PubMed Central PMCID: PMC1681482.
2. Bernhart S H, Hofacker I L, Stadler P F. Local RNA base pairing probabilities in large sequences. Bioinformatics. 2006; 22(5):614-5. doi: 10.1093/bioinformatics/btk014. PubMed PMID: 16368769.
3. Biswas A, Gagnon J N, Brouns S J, Fineran P C, Brown C M. CRISPRTarget: bioinformatic prediction and analysis of crRNA targets. RNA biology. 2013; 10(5):817-27. doi: 10.4161/rna.24046. PubMed PMID: 23492433; PubMed Central PMCID: PMC3737339.
4. Camacho C, Coulouris G, Avagyan V, Ma N, Papadopoulos J, Bealer K, et al. BLAST+: architecture and applications. BMC bioinformatics. 2009; 10:421. doi: 10.1186/1471-2105-10-421. PubMed PMID: 20003500; PubMed Central PMCID: PMC2803857.
5. Crooks G E, Hon G, Chandonia J M, Brenner S E. WebLogo: a sequence logo generator. Genome research. 2004; 14(6):1188-90. doi: 10.1101/gr.849004. PubMed PMID: 15173120; PubMed Central PMCID: PMC419797.
6. Edgar R C. PILER-CR: fast and accurate identification of CRISPR repeats. BMC bioinformatics. 2007; 8:18. doi: 10.1186/1471-2105-8-18. PubMed PMID: 17239253; PubMed Central PMCID: PMC1790904.
7. Gerdes S Y, Scholle M D, Campbell J W, Balazsi G, Ravasz E, Daugherty M D, et al. Experimental determination and system level analysis of essential genes in *Escherichia coli* MG1655. Journal of bacteriology. 2003; 185(19):5673-84. PubMed PMID: 13129938; PubMed Central PMCID: PMC193955.
8. Heidrich N, Dugar G, Vogel J, Sharma C M. Investigating CRISPR RNA Biogenesis and Function Using RNA-seq. Methods in molecular biology. 2015; 1311:1-21. doi: 10.1007/978-1-4939-2687-9_1. PubMed PMID: 25981463.
9. Henikoff S, Henikoff J G. Amino acid substitution matrices from protein blocks. Proceedings of the National Academy of Sciences of the United States of America. 1992; 89(22):10915-9. PubMed PMID: 1438297; PubMed Central PMCID: PMC50453.
10. Li H, Durbin R. Fast and accurate short read alignment with Burrows-Wheeler transform. Bioinformatics. 2009; 25(14):1754-60. doi: 10.1093/bioinformatics/btp324. PubMed PMID: 19451168; PubMed Central PMCID: PMC2705234.
11. Lorenz R, Bernhart S H, Honer Zu Siederdissen C, Tafer H, Flamm C, Stadler P F, et al. ViennaRNA Package 2.0. Algorithms for molecular biology: AMB. 2011; 6:26. doi: 10.1186/1748-7188-6-26. PubMed PMID: 22115189; PubMed Central PMCID: PMC3319429.
12. Moller S, Croning M D, Apweiler R. Evaluation of methods for the prediction of membrane spanning regions. Bioinformatics. 2001; 17(7):646-53. PubMed PMID: 11448883.
13. Remmert M, Biegert A, Hauser A, Soding J. HHblits: lightning-fast iterative protein sequence searching by HMM-HMM alignment. Nature methods. 2012; 9(2):173-5. doi: 10.1038/nmeth.1818. PubMed PMID: 22198341.
14. Shmakov S, Abudayyeh 00, Makarova K S, Wolf Y I, Gootenberg J S, Semenova E, et al. Discovery and Functional Characterization of Diverse Class 2 CRISPR-Cas Systems. Molecular cell. 2015; 60(3):385-97. doi: 10.1016/j.molcel.2015.10.008. PubMed PMID: 26593719; PubMed Central PMCID: PMC4660269.
15. Yates A, Akanni W, Amode M R, Barrell D, Billis K, Carvalho-Silva D, et al. Ensembl 2016. Nucleic acids research. 2016; 44(D1):D710-6. doi: 10.1093/nar/gkv1157. PubMed PMID: 26687719; PubMed Central PMCID: PMC4702834.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (800 sequences)

SEQ ID NO: 1 - protein, 7 aa, Simian virus
PKKKRKV

SEQ ID NO: 2 - protein, 16 aa, Artificial Sequence
  Synthetic
KRPAATKKAGQAKKKK

SEQ ID NO: 3 - protein, 9 aa, Artificial Sequence
  Synthetic
PAAKRVKLD

SEQ ID NO: 4 - protein, 11 aa, Artificial Sequence
  Synthetic
RQRRNELKRSP

SEQ ID NO: 5 - protein, 38 aa, Artificial Sequence
  Synthetic
NQSSNFGPMKGGNFGGRSSGPYGGGGQYFAKPRNQGGY

SEQ ID NO: 6 - protein, 42 aa, Artificial Sequence
  Synthetic
RMRIZFKNKGKDTAELRRRRVEVSVELRKAKKDEQILKRRNV

SEQ ID NO: 7 - protein, 8 aa, Artificial Sequence
  Synthetic
VSRKRPRP

SEQ ID NO: 8 - protein, 8 aa, Artificial Sequence
  Synthetic
PPKKARED

SEQ ID NO: 9 - protein, 8 aa, Homo sapiens
PQPKKKPL

SEQ ID NO: 10 - protein, 12 aa, Mus
SALIKKKKKMAP

SEQ ID NO: 11 - protein, 5 aa, influenza NS1
DRLRR

SEQ ID NO: 12 - protein, 7 aa, influenza NS1
PKQKKRK

SEQ ID NO: 13 - protein, 10 aa, Hepatitis virus
RKLKKKIKKL

SEQ ID NO: 14 - protein, 10 aa, mus
REKKKFLKRR

SEQ ID NO: 15 - protein, 20 aa, Homo sapiens
KRKGDEVDGVDEVAKKKSKK

SEQ ID NO: 16 - protein, 17 aa, Homo sapiens
RKCLQAGMNLEARKTKK

SEQ ID NO: 17 - protein, 5 aa, Artificial Sequence
  Synthetic
GGGGS

SEQ ID NO: 18 - DNA, 20 bp, Artificial Sequence
  Synthetic
gagtccgagcagaagaagaa

SEQ ID NO: 19 - DNA, 20 bp, Artificial Sequence
  Synthetic
gagtcctagcaggagaagaa

SEQ ID NO: 20 - DNA, 20 bp, Artificial Sequence
  Synthetic
gagtctaagcagaagaagaa

SEQ ID NO: 21 - protein, 12 aa, Artificial Sequence
  Synthetic
FWYHKMILVAGC

SEQ ID NO: 22 - protein, 4 aa, Artificial Sequence
  Synthetic
FWYH

SEQ ID NO: 23 - protein, 3 aa, Artificial Sequence
  Synthetic
ILV

SEQ ID NO: 24 - protein, 12 aa, Artificial Sequence
  Synthetic
WYHKREDCSTNQ

SEQ ID NO: 25 - protein, 5 aa, Artificial Sequence
  Synthetic
HKRED

SEQ ID NO: 26 - protein, 3 aa, Artificial Sequence
  Synthetic
HKR

SEQ ID NO: 27 - protein, 2 aa, Artificial Sequence
  Synthetic
ED

SEQ ID NO: 28 - protein, 9 aa, Artificial Sequence
  Synthetic
VCAGSPTND

SEQ ID NO: 29 - protein, 3 aa, Artificial Sequence
  Synthetic
AGS

SEQ ID NO: 30 - DNA, 36 bp, Phaeodactylibacter xiamenensis
gtcctagtcactcctcaaaccgggagcctatcggac

SEQ ID NO: 31 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 32 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 33 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 34 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 35 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 36 - protein, 1095 aa, Riemerella anatipestifer; identical to SEQ ID NO: 35

SEQ ID NO: 37 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 38 - protein, 1095 aa, Riemerella anatipestifer; identical to SEQ ID NO: 35

SEQ ID NO: 39 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 40 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 41 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 42 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 43 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 44 - protein, 1095 aa, Riemerella anatipestifer; identical to SEQ ID NO: 35

SEQ ID NO: 45 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 46 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 47 - protein, 1135 aa, Porphyromonas gingivalis; identical to SEQ ID NO: 31

SEQ ID NO: 48 - protein, 1127 aa, Prevotella sp
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 49 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 50 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 51 - protein, 171 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFNSLCILNNTDF

SEQ ID NO: 52 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 53 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 54 - protein, 1224 aa, Bergeyella zoohelcum; identical to SEQ ID NO: 49

SEQ ID NO: 55 - protein, 1127 aa, Prevotella buccae; identical to SEQ ID NO: 34

SEQ ID NO: 56 - protein, 1127 aa, Prevotella buccae; identical to SEQ ID NO: 37

SEQ ID NO: 57 - protein, 1095 aa, Riemerella anatipestifer; identical to SEQ ID NO: 35

SEQ ID NO: 58 - protein, 1135 aa, Porphyromonas gingivalis; identical to SEQ ID NO: 31

SEQ ID NO: 59 - protein, 1125 aa, Prevotella pallens; identical to SEQ ID NO: 40

SEQ ID NO: 60 - protein, 1159 aa, Myroides odoratimimus; identical to SEQ ID NO: 43

SEQ ID NO: 61 - protein, 1127 aa, Prevotella sp; identical to SEQ ID NO: 48

SEQ ID NO: 62 - protein, 1135 aa, Porphyromonas gingivalis; identical to SEQ ID NO: 32

SEQ ID NO: 63 - protein, 1119 aa, Porphyromonas gingivalis; identical to SEQ ID NO: 33

SEQ ID NO: 64 - protein, 1119 aa, Porphyromonas gingivalis; identical to SEQ ID NO: 39

SEQ ID NO: 65 - protein, 1199 aa, Capnocytophaga canimorsus; identical to SEQ ID NO: 41

SEQ ID NO: 66 - protein, 1179 aa, Flavobacterium columnare; identical to SEQ ID NO: 42

SEQ ID NO: 67 - protein, 1145 aa, Psychroflexus torquis; identical to SEQ ID NO: 50

SEQ ID NO: 68 - protein, 171 aa, Riemerella anatipestifer; identical to SEQ ID NO: 51

SEQ ID NO: 69 - protein, 948 aa, Riemerella anatipestifer; identical to SEQ ID NO: 52

SEQ ID NO: 70 - protein, 698 aa, Porphyromonas gingivalis
MRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKSEFHLPRGIFTEAVRDCLIEMGHDEVGSYKEVGFMAKAVPLYFERACKDRVQPFYDYPFNVGNSLKPKKGRFLSKEDRAEEWESGKERFRLAKLKKEILEAKEHPYLDFKSWQKFERELRLVKNQDIITWMMCRDLMEENKVEGLDTGTLYLKDIRTDVYEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDESFREMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 71 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 72 - protein, 754 aa, Porphyromonas gingivalis
MRDLDCFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEIDTLDRLDACLADKGIRRGHLPRQIIAILSQEHKDMEEKVRKKLQEMIADTDHRLDMLDRQTDRKIRIDRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYNYPFNVGNILKPKKGRFLSKEKRAEEWESGKERFRDLEAWSQSTARRIEDAFAGIKYASPGNKKKIEQLLQDLSLWETFESKLKVKADKINLAKLKKEILEAKEHPYLDFKSWQKFERELRLVKNQDIITWMMCRDLMEENKVEGLDTGTLYLKDIWTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 73 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 74 - protein, 754 aa, Porphyromonas gingivalis
MRDLDYFETGDKPYITQTTPHYHIEKGKIGLRFVPEGQHLWPSPEVGATRTGRSKYAQDKRLTAEAFLSVHELMPMMFYYFLLREKYSEEASAERVQGRIKRVIEDVYAVYDAFARGEIDTLDRLDACLADKGIRRGHLPRQMIAILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGHDEVASYKEVGFMAKAVPLYFERACKDRVQPFYDYPFNVGNSLKPKKGRFLSKEKRAEEWESGKERFRDLEAWSQSAVRRIEDAFAGIENASRENKKKIEQLLQDLSLWKAFESKLKVRGDKINIAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSSPDAIEERMGLNIAHRLSEEVKQAKETVERIIQA

SEQ ID NO: 75 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 76 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 77 - protein, 1139 aa, Prevotella pleuritidis; identical to SEQ ID NO: 76

SEQ ID NO: 78 - protein, 1135 aa, Porphyromonas gingivalis; identical to SEQ ID NO: 71

SEQ ID NO: 79 - protein, 1135 aa, Porphyromonas gingivalis; identical to SEQ ID NO: 73

SEQ ID NO: 80 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 81 - protein, 1135 aa, Porphyromonas gingivalis; identical to SEQ ID NO: 75

SEQ ID NO: 82 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 83 - protein, 1135 aa, Porphyromonas gingivalis; identical to SEQ ID NO: 82

SEQ ID NO: 84 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 85 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 86 - protein, 1135 aa, Porphyromonas gingivalis; identical to SEQ ID NO: 32

SEQ ID NO: 87 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 88 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 89 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 90 - protein, 1175 aa, Porphyromonas sp
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 91 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 92 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 93 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 94 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 95 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 96 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 97 - protein, 1175 aa, Porphyromonas gulae; identical to SEQ ID NO: 92

SEQ ID NO: 98 - protein, 1115 aa, Bacteroides pyogenes; identical to SEQ ID NO: 84

SEQ ID NO: 99 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 100 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 101 - protein, 1322 aa, Prevotella sp
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 102 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 103 - protein, 1119 aa, Porphyromonas gingivalis; identical to SEQ ID NO: 87

SEQ ID NO: 104 - protein, 1175 aa, Porphyromonas gulae; identical to SEQ ID NO: 89

SEQ ID NO: 105 - protein, 1119 aa, Porphyromonas gulae; identical to SEQ ID NO: 96

SEQ ID NO: 106 - protein, 1119 aa, Porphyromonas gulae; identical to SEQ ID NO: 94

SEQ ID NO: 107 - protein, 1175 aa, Porphyromonas sp; identical to SEQ ID NO: 90

SEQ ID NO: 108 - protein, 1175 aa, Porphyromonas gulae; identical to SEQ ID NO: 91

SEQ ID NO: 109 - protein, 1175 aa, Porphyromonas gulae; identical to SEQ ID NO: 92

SEQ ID NO: 110 - protein, 1174 aa, Porphyromonas gulae; identical to SEQ ID NO: 95

SEQ ID NO: 111 - protein, 1135 aa, Porphyromonas gulae; identical to SEQ ID NO: 93

SEQ ID NO: 112 - protein, 335 aa, Capnocytophaga canimorsus
MDEKPTIIKGKTFKGNEALFAHWFRYYKEYQNFQTFYDTENYPLVKLGKKQADRKRKTKIYQQKKNDVFTLLMAKHIFKSVFKQDSIDRFSLEDLYQSREERLGNQERARQTGERNTNYIWNKTVDLKLCDGKITVENVKLKNVGDFIKYEYDQRVQAFLTYEENIEWQAFLIKESKEEENYPYVVEREIEQYEKVRREELLKEVHLIEEYILEKVKDKEILKKGDNQNFKYYILNGLLKQVKKEKEKEDVESYKVFNLNTKPEDVDINQLKQKATDLEQKAFVLTYIRNKFAHNQLPKKFWDYCQEECGKIAKGKTYAEYFVEVFKREKEALMK

SEQ ID NO: 113 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 114 - protein, 98 aa, Psychroflexus torquis
MYVLNGLLTGIKQINIEDFIVLKQNTNFDKIDFKGIASYSVLEKKTIILIAIRNKFAHNQLPNKIINDLANEFVKKEKNETYANYYLKVLKKMISDLA

SEQ ID NO: 115 - protein, 335 aa, Capnocytophaga canimorsus; identical to SEQ ID NO: 112

SEQ ID NO: 116 - protein, 1218 aa, Capnocytophaga cynodegmi; identical to SEQ ID NO: 113

SEQ ID NO: 117 - protein, 1090 aa, Prevotella sp
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 118 - protein, 1090 aa, Prevotella sp
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 119 - protein, 1090 aa, Prevotella sp
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 120 - protein, 1090 aa, Prevotella sp; identical to SEQ ID NO: 119

SEQ ID NO: 121 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEIDTLDRLDACLADKGIRRGHLPRQIIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGHDEVASYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSLDAIEERMGLNIAHRLSEEVKQAKETVERIIQA

SEQ ID NO: 122 - protein, 1119 aa, Porphyromonas gingivalis
MTEQNERPYNGTYYTLEDKHFWAAFLNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLCEEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKSEFHLPRGIFTEAVRDCLIEMGHDEVGSYKEVGFMAKAVPLYFERACKDRVQPFYDYPFNVGNSLKPKKGRFLSKEDRAEEWESGKERFRLAKLKKEILEAKEHPYLDFKSWQKFERELRLVKNQDIITWMMCRDLMEENKVEGLDTGTLYLKDIRTDVYEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDESFREMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 123 - protein, 1175 aa, Porphyromonas gingivalis
MTEQNERPYNGTYYTLEDKHFWAAFLNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPIDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGLDEVGSYKEVGFMAKAVPLYFERACKDRVQPFYNYPFNVGNILKPKKGRFLSKEKRAEEWESGKERFRDLEAWSQSTARRIEDAFAGIKYASPGNKKKIEQLLQDLSLWETFESKLKVKADKINLAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKETVERIIQA

SEQ ID NO: 124 - protein, 1119 aa, Porphyromonas gingivalis
MTEQNERPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSVHELMPMMFYYFLLRENYSDEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAARDCLIEMGHDEVASYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKSFREMLESWSDPLLDKWPDLHRKVRLLIAVRNAFSHNQYPMYDEAVFSSIRKYDPSSLDAIEERMGLNIAHRLSEEVKQAKEMVERIIQV

SEQ ID NO: 125 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDTHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEASAERVQGRIKRVIEDVYAVYDAFARGEIDTLDRLDACLADKGIRRGHLPRQMIAILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGHDEVASYKEVGFMAKAVPLYFERACKDRVQPFYDYPFNVGNSLKPKKGRFLSKEKRAEEWESGKERFRDLEAWSQSAVRRIEDAFAGIENASRENKKKIEQLLQDLSLWKAFESKLKVRGDKINIAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSSPDAIEERMGLNIAHRLSEEVKQAKETVERIIQA

SEQ ID NO: 126 - protein, 1175 aa, Porphyromonas gingivalis
MTEQNERPYNGTYYTLEDKHFWAAFLNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREETVTEAGLLFFVSLFLEKRDAIWMQKKIRGFKGGTETYQQMTNEVFYRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEIDTLDRLDACLADKGIRRGHLPRQIIAILSQEHKDMEEKVRKKLQEMIADTDHRLDMLDRQTDRKIRIDRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYNYPFNVGNILKPKKGRFLSKEKRAEEWESGKERFRDLEAWSQSTARRIEDAFAGIKYASPGNKKKIEQLLQDLSLWETFESKLKVKADKINLAKLKKEILEAKEHPYLDFKSWQKFERELRLVKNQDIITWMMCRDLMEENKVEGLDTGTLYLKDIWTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 127 - protein, 1090 aa, Prevotella sp; identical to SEQ ID NO: 118

SEQ ID NO: 128 - protein, 1090 aa, Prevotella sp; identical to SEQ ID NO: 117

SEQ ID NO: 129 - protein, 1131 aa, Phaeodactylibacter xiamenensis; identical to SEQ ID NO: 88

SEQ ID NO: 130 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 131 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 132 - protein, 1175 aa, Porphyromonas gulae; identical to SEQ ID NO: 131

SEQ ID NO: 133 - protein, 953 aa, Alistipes sp
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 134 - protein, 1095 aa, Riemerella anatipestifer; identical to SEQ ID NO: 35

SEQ ID NO: 135 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 136 - protein, 171 aa, Riemerella anatipestifer; identical to SEQ ID NO: 51

SEQ ID NO: 137 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 138 - protein, 1095 aa, Riemerella anatipestifer; identical to SEQ ID NO: 35

SEQ ID NO: 139 - protein, 948 aa, Riemerella anatipestifer; identical to SEQ ID NO: 135

SEQ ID NO: 140 - protein, 1135 aa, Porphyromonas gingivalis; identical to SEQ ID NO: 31

SEQ ID NO: 141 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 142 - protein, 1132 aa, Prevotella intermedia; identical to SEQ ID NO: 137

SEQ ID NO: 143 - protein, 1088 aa, Bacteroides pyogenes
MALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 144 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 145 - protein, 1149 aa, Prevotella saccharolytica
MEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 146 - protein, 1123 aa, Prevotella intermedia
MEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 147 - protein, 1175 aa, Porphyromonas gingivalis; identical to SEQ ID NO: 141

SEQ ID NO: 148 - protein, 1224 aa, Bergeyella zoohelcum; identical to SEQ ID NO: 49

SEQ ID NO: 149 - protein, 1126 aa, Prevotella intermedia; identical to SEQ ID NO: 99

SEQ ID NO: 150 - protein, 1127 aa, Prevotella buccae; identical to SEQ ID NO: 37

SEQ ID NO: 151 - protein, 1135 aa, Porphyromonas gingivalis; identical to SEQ ID NO: 32

SEQ ID NO: 152 - protein, 1115 aa, Bacteroides pyogenes; identical to SEQ ID NO: 84

SEQ ID NO: 153 - protein, 953 aa, Alistipes sp; identical to SEQ ID NO: 133

SEQ ID NO: 154 - protein, 1322 aa, Prevotella sp; identical to SEQ ID NO: 101

SEQ ID NO: 155 - protein, 1095 aa, Riemerella anatipestifer; identical to SEQ ID NO: 35

SEQ ID NO: 156 - protein, 1124 aa, Prevotella aurantiaca; identical to SEQ ID NO: 85

SEQ ID NO: 157 - protein, 1151 aa, Prevotella saccharolytica; identical to SEQ ID NO: 144

SEQ ID NO: 158 - protein, 1159 aa, Myroides odoratimimus; identical to SEQ ID NO: 43

SEQ ID NO: 159 - protein, 1179 aa, Flavobacterium columnare; identical to SEQ ID NO: 42

SEQ ID NO: 160 - protein, 1088 aa, Bacteroides pyogenes; identical to SEQ ID NO: 143

SEQ ID NO: 161 - protein, 1199 aa, Capnocytophaga canimorsus; identical to SEQ ID NO: 41

SEQ ID NO: 162 - protein, 1218 aa, Capnocytophaga cynodegmi; identical to SEQ ID NO: 113

SEQ ID NO: 163 - protein, 1145 aa, Chryseobacterium sp
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 164 - protein, 1131 aa, Phaeodactylibacter xiamenensis; identical to SEQ ID NO: 88

SEQ ID NO: 165 - protein, 1175 aa, Porphyromonas gingivalis; identical to SEQ ID NO: 121

SEQ ID NO: 166 - protein, 1135 aa, Porphyromonas gulae; identical to SEQ ID NO: 93

SEQ ID NO: 167 - protein, 1175 aa, Porphyromonas gulae; identical to SEQ ID NO: 92

SEQ ID NO: 168 - protein, 1119 aa, Porphyromonas gulae; identical to SEQ ID NO: 96

SEQ ID NO: 169 - protein, 1133 aa, Prevotella falsenii; identical to SEQ ID NO: 100

SEQ ID NO: 170 - protein, 1132 aa, Prevotella intermedia; identical to SEQ ID NO: 137

SEQ ID NO: 171 - protein, 1123 aa, Prevotella intermedia; identical to SEQ ID NO: 146

SEQ ID NO: 172 - protein, 1125 aa, Prevotella pallens; identical to SEQ ID NO: 40

SEQ ID NO: 173 - protein, 1139 aa, Prevotella pleuritidis; identical to SEQ ID NO: 76

SEQ ID NO: 174 - protein, 1116 aa, Prevotella pleuritidis; identical to SEQ ID NO: 102

SEQ ID NO: 175 - protein, 1149 aa, Prevotella saccharolytica; identical to SEQ ID NO: 145

SEQ ID NO: 176 - protein, 1090 aa, Prevotella sp; identical to SEQ ID NO: 119

SEQ ID NO: 177 - protein, 1145 aa, Psychroflexus torquis; identical to SEQ ID NO: 50

SEQ ID NO: 178 - protein, 201 aa, Bergeyella zoohelcum
MIELINFSAEYVFGKAPLITAGNLSDGLLFFAIALFIGCLIHIITFWLIKRKWYKKLACTPMDKMKNDEYITEILPDLKEIYRTNKGISVTENISNGSVFDTAYYYLEAQGKISQAKNFQSIYFLFRNIVTLSLFVLPVSVIFLLASFFMNDCSLSEKIITIIIGTFVLGGLSSVIAQWFRVKMTDRIFGLYYAELTHNKK

SEQ ID NO: 179 - protein, 192 aa, Prevotella sp
MIIALITSLFSSATIIFAGYRTYRNAIKKLREESIENIKRAHYEAILKAHQSIYKLLRFTTDTENDDCILVWEQPKDGGEKTYYFRQANIRQFFKELTEEVYNKGNGIYLSKEVMSLIFKYRTLVHKLLLAEKNNPDEKIMIHNREVVKEMIEINQSLSIQIRKDIDLQQRNLYNHNKKGKKYWWKRKKQNI

SEQ ID NO: 180 - protein, 177 aa, Prevotella buccae
MDYMELAKEAFSIICTFIAAYVAYYYAIKQLHQKSVENIEYAKYQAVLQAHKSLYKLLRFTTNTENEDSILIWEKTKDGKQEATYYFRKENIRKFIKELSKEIYNEGCGIFMSKEALSLISEYRNIVYGFMLSAQNNPQETIRITNRESVERMKKIHQNLSIEIRQAINLKKRDLRF

SEQ ID NO: 181 - protein, 238 aa, Porphyromonas gingivalis
MEKFSLYDFLAIILPGIAFIVVFRIIFSSLHLSLPVDIPLGLESTIVYALICGAVLYVLSFSLVKLFPRLFGLYRHVADLYQKMKALHPIMNDTLNRQAEQWGLGKIYLSEEEFCQSEEKEKIRMLQSDFYDRMWYRLDFRGKLGNAKSFQCYYFFFRHSFWGLVLISLILLSYKLLAYIPACDMEDIGWREYSDIAVPIMILSALFVFLAQWFRIKMVEKMYWTFYISLIEQENSNL

SEQ ID NO: 182 - protein, 235 aa, Bacteroides pyogenes
MNKFSLYDFLSILLPGVIFLVAIRVAQPFWRFNTGLYFPQGWEFSLVYSLVIGASLYVLGFSVKKNYSVFFRRLGLYEHVTILYHRFETLHPFMNGALNKYAEEWNGTKPYCTVEQYDAMDASAQKEIEDAQDIFYDHMYYRLDCKGKLEGAKAFQSYYLCFLHSFLGLLIFGVYLLICILLSYFMDVLLADTWQVAFLFLMNLCVMYLFMRLARWFRQRMVLKMYWAFYESLIE

SEQ ID NO: 183 - protein, 178 aa, Riemerella anatipestifer
MYWILEVLKIVTPTIAVIVSAIVSTIVLSRKIRQELKGNIERQKYEDILHAHKQMYRLLAYMTDQDNPKNLLKWEVPKGQKDKIHYINRANAQAFLRELPELFYGEGCGLFLSEEVTKKFFEYRSIVHKLLLAEQNSTEAEFRLKNEEAATRMKVLHHKLSQSIRQCLKIEQRDLKAL

SEQ ID NO: 184 - protein, 189 aa, Prevotella aurantiaca
MDCTLISKEVATALLSTISSFIPIVIAAYLTYRYAIKKLHKESIENIERAKYEAILKAHQSIYKLLRFTTDTENDDCILLWEQSKGSKEKVYYFRQANIRKFIKELTEEIYNKGNGIYLSKEVILLVFKYRTLVHKLLLAEKNNPDEKIMISKQEIAKSMIEIHQSLSIQIRNDINLKKRDLCLNSENT

SEQ ID NO: 185 - protein, 226 aa, Myroides odoratimimus
MDKLSLYELFSFVIPGGIALHLLNWCSVNVLSTGTLFNLSDLSNSLIALVFALLIGVTLHIITFNILLKCGSYRQIIYKSVQEIKLDDYIQQVIPFLNQEYFHNKKHEVAANTNNAVPAENLFDYAYYYLEVNGKNAQAKNFQSLYFFFRNMFTLGIVSIVILIIALVYSTITSVGKDVLSEIVFKIAFFAVIIGIAVPVANWLRKKMIITVFGCYYADRVHQTNK

SEQ ID NO: 186 - protein, 235 aa, Bacteroides pyogenes
MNKFSFYDFLSILLPGVIFLVAIRVAQLFWRFNTGLYFPQGWEFSLVYSLVIGASLYVLGFSVKKNYSGFFRCLGLYEHVTILYYRFETLHPFMNGALNKYAEEWNGTKPYCTVEQYDAMDASAQKEIEDAQDIFYDHMYYRLDCKGKLEGAKAFQSYYLCFLHSFLGLLIFGVYLLICILLSYFMDVLLADTWQVAFLFLMNLCVMYLFMRLARWFRQRMVLKMYWAFYESLIE

SEQ ID NO: 187 - protein, 124 aa, Capnocytophaga canimorsus
MDRLSIYELLSFVVPGVIMIELINFSAEYVFGKDRLITAGNLSDGLLFFAIALFIGCLIHIITFRLIKRKWYKKLAYKPINEIENNAYIKQIFTTLKEEYSKIHNINSIDEISKLNIFEAVITT

SEQ ID NO: 188 - protein, 219 aa, Capnocytophaga cynodegmi
MERLSIYELLSFVVLGVIMIELMNFSAEYVFGKAPLITAGNLSDSLLFFAIALFIGCLIHIITFRLIKRKWYQKLACTPMDKMKNDEYITEILPHLKEIYRANKGISATENISNGSVFDTAYYYLEAQGKISQAKNFQSIYFLFRNIVTLSLFVLPVSVIFLLASFFMNDCKLSGKIITIVIGTLVIGGISSVIAQWFRVKMTDRIFGLYYAELTHHKK

SEQ ID NO: 189 - protein, 211 aa, Phaeodactylibacter xiamenensis
MDEGTLLINILTGPAKDKPLWFEFIGIGVTISLAAWGYLRAFGAWEKQKKRELELQHKQRKLEIKLQFEKQRYEHELKAAEGVWPLLAYFSLWENDKSVFVKRGDHWYFRQEQGREYILALSENFFNKGYGVFMPGPAKENLYHFRGMIYKLLQDSKSNGNDNNEVLLKNQSMVQKKDKQAAPNKKSVEQLKDEINASLRNMLQKSEIDLD

SEQ ID NO: 190 - protein, 181 aa, Porphyromonas gingivalis
MMTMTICWTPICVQLIKLSGIFIAAYLAYRYAVHKLSKESIENIERCKYQAVLEAHRSFYKLLRFTTDTENADSILVWQKAKGGGAKTYYFRPACIRGFLSELTDEFYKNGNGIFLSKEIISRIFEYRSIVYGLLLSERQNSDERVVMNKPETAERMISIHQELTQTVREAIALKKRTLNF

SEQ ID NO: 191 - protein, 238 aa, Porphyromonas gulae
MEKFSLYDFLAIILPGIAFIVVFRVVFSSLHLSLPVDIPLDLEFTIVYALICGAVLYVLSFSLVKLFPRLFGLYRHVADLYQRMKALHPIMNDTLNRQAEQWGLGRIYLSEEEYCRSEEKEKIRMLQSDFYNRMWYRLDFRGKLGNAKSFQCYYFFFRHSFLGLVLISLILLSYKLLAYIPACELEDIGWKEYSDIAVPIIILSVLFVFLAQWFRIKMVEKMYWTFYISLIEQENSNL

SEQ ID NO: 192 - protein, 181 aa, Porphyromonas gulae
MMTMTICWTPICVQLIKLSGIFIAAYLAYRYAVRKLSKESIENIERCKYQAVLEAHRSFYKLLRFTTDTENADSILVWQKAKGGGAKTYYFRPACIRGFLSELTDEFYKNGNGVFLSKEIISRIFEYRSIVYGLLLSERQNSDERIVMNKPETAERMIRIHQELTQTVREAIALKGRTLNF

SEQ ID NO: 193 - protein, 180 aa, Porphyromonas gulae
MTMTICWTPICVQLIELSGIFIAAYLAYRYAVRKLSKESIENIERCKYQAVLEAHRSFYKLLRFTTDTENADSILVWQKAKGGGAKTYYFRPACIRGFLSELTDEFYKNGNGVFLSKEIISRIFEYRSIVYGLLLSERDSSDERIVMNKPETAERMIRIHQELTQTVREAIALKGRTLNF

SEQ ID NO: 194 - protein, 170 aa, Prevotella falsenii
MIIALIPALINSAAIIVVVYLTYFYAVKKLREESFENIERAKYEAILKAHQSVYKLLRFITDTENDDCILVWEEPKGGGEKAYYFRQANIRKFIRELTEEIYNKGNGIFLSKKTMSLIFEYRTLVYGLLLTAKDNPAEAIEITNKKLAKRMIEIHQSLSIQIRKDRNLQQ

SEQ ID NO: 195 - protein, 201 aa, Prevotella intermedia
MDCTLISKEVATALFSTISSLIPIVIAAYLTYRYAIKKLRKESFENIERAKYEAILKAHQSIYKLLRFITDTENDDCILVWEQPKGGGEKTYYFRQANIRKFIKELTEEIYNKGNGIFLSKKVMPLIFEYRSLVYGLLLTAKDKPDETIEIKNEKLAKRMIEIHQSLSIQIRKDINLKQRDLQLDNKKGKKWCWKRKKQNI

SEQ ID NO: 196 - protein, 186 aa, Prevotella intermedia
MDCTLISKEVATAMFSTISSLIPIVIAAYLTYRYAIKKLRKESFENIERAKYEAVLKAHQSIYKLLRFITDTENDDCIMVWEQPKGGGEKVYYFRQANIRKFIKELTEEIYNKGNGIFLSKKVMPLIFEYRSLVYGLLLTAKDKPDETIEIKNEKLAKRMIEIHQSLSIQIRKDINLKQRDLQFDS

SEQ ID NO: 197 - protein, 185 aa, Prevotella pleuritidis
MDCTLISKEVATALFSTLSSLVPIVIAAYLTYRYAIKKLHKESFESIECAKYEAILKAHQSIYKLLRFITDTENDDCILVWEQPKGGGENVYYFRQANIRKFIKELTEEIYNKGNGIFLSKEVMSLIFEYRSLVYGLLLTEKDNPKDKIIIKNLKLAKRMIEIHQNLSIKIREAINLQQRDLHFK

SEQ ID NO: 198 - protein, 185 aa, Prevotella pleuritidis
MDCTLISKEVATALFSTLSSLVPIVIAAYLTYRYAIKKLHKESFESIECAKYEAILKAHQSIYKLLRFITDTENDDCILVWEQPKGGGEKTYYFRQANIRKFIKELTEEIYNKGNGIYLSKEVMSLIFKYRTLVHKLLLAKKNNPDEKIMIDKRELAKRMIEIHQNLSIKIREAINLQQRDLHFK

SEQ ID NO: 199 - protein, 180 aa, Prevotella saccharolytica
MECNDCSQLITTLVSLLTAALSGFLSYYFAVRKYRKESQENVERWKYEAIWHAHQSFYKLLRFMTDNENADSILVFRKQEGSKQPQPIFRKDKAREFLAELTDEFYKKGNGLFLSKEVADSLFKYRHIVFGLLQVFSNYDENEVQLKNTQAVENMKKNFQQLSPEIRKSLHLHRRDLLFS

SEQ ID NO: 200 - DNA, 183 bp, Artificial Sequence
  Synthetic
  misc_feature (60)..(66): n is a, c, g, or t
gggcgatggtccataccttagatgcgttagcattaatcaggcaacggctctctagatagnnnnnnngtaggctctttgtgcctctacgccatctccatagagccctcaaccggagtttgaagcatggcttctaactttactcagttcgttctcgtcgacaatggcggaactggcgacgtgact

SEQ ID NO: 201 - DNA, 183 bp, Artificial Sequence
  Synthetic
  misc_feature (90)..(96): n is a, c, g, or t
gggcgatggtccataccttagatgcgttagcattaatcaggcaacggctctctagataggtaggctctttgtgcctctacgccatctccnnnnnnnatagagccctcaaccggagtttgaagcatggcttctaactttactcagttcgttctcgtcgacaatggcggaactggcgacgtgact

SEQ ID NO: 202 - DNA, 200 bp, Artificial Sequence
  Synthetic
  misc_feature (77)..(83): n is a, c, g, or t
taatacgactcactatagggcgatggtccataccttagatgcgttagcattaatcaggcaacggctctctagatagnnnnnnngtaggctctttgtgcctctacgccatctccatagagccctcaaccggagtttgaagcatggcttctaactttactcagttcgttctcgtcgacaatggcggaactggcgacgtgact

SEQ ID NO: 203 - DNA, 200 bp, Artificial Sequence
  Synthetic
  misc_feature (107)..(113): n is a, c, g, or t
taatacgactcactatagggcgatggtccataccttagatgcgttagcattaatcaggcaacggctctctagataggtaggctctttgtgcctctacgccatctccnnnnnnnatagagccctcaaccggagtttgaagcatggcttctaactttactcagttcgttctcgtcgacaatggcggaactggcgacgtgact

SEQ ID NO: 204 - RNA, 36 nt, Artificial Sequence
  Synthetic
guuggaacugcucucauuuuggaggguaaucacaac

SEQ ID NO: 205 - RNA, 88 nt, Artificial Sequence
  Synthetic
guuggaacugcucucauuuuauucgugaaguuuuuauuuguuuucaaaggaacucaugaauacagaguauuuggaggguaauaacaac

SEQ ID NO: 206 - DNA, 10 bp, Artificial Sequence
  Synthetic
ggcacaagct

SEQ ID NO: 207 - DNA, 30 bp, Artificial Sequence
  Synthetic
ggagtacaactacaacagccacaacgtcta

SEQ ID NO: 208 - DNA, 10 bp, Artificial Sequence
  Synthetic
tatcatggcc

SEQ ID NO: 209 - DNA, 10 bp, Artificial Sequence
  Synthetic
accctggtga

SEQ ID NO: 210 - DNA, 30 bp, Artificial Sequence
  Synthetic
accgcatcgagctgaagggcatcgacttca

SEQ ID NO: 211 - DNA, 10 bp, Artificial Sequence
  Synthetic
aggaggacgg

SEQ ID NO: 212 - DNA, 10 bp, Artificial Sequence
  Synthetic
atcgacttca

SEQ ID NO: 213 - DNA, 30 bp, Artificial Sequence
  Synthetic
aggaggacggcaacatcctggggcacaagc

SEQ ID NO: 214 - DNA, 10 bp, Artificial Sequence
  Synthetic
tggagtacaa

SEQ ID NO: 215 - DNA, 10 bp, Artificial Sequence
  Synthetic
tggggcacaa

SEQ ID NO: 216 - DNA, 30 bp, Artificial Sequence
  Synthetic
gctggagtacaactacaacagccacaacgt

SEQ ID NO: 217 - DNA, 10 bp, Artificial Sequence
  Synthetic
ctatatcatg

SEQ ID NO: 218 - DNA, 10 bp, Artificial Sequence
  Synthetic
accacatgaa

SEQ ID NO: 219 - DNA, 30 bp, Artificial Sequence
  Synthetic
gcagcacgacttcttcaagtccgccatgcc

SEQ ID NO: 220 - DNA, 10 bp, Artificial Sequence
  Synthetic
cgaaggctac

SEQ ID NO: 221 - DNA, 10 bp, Artificial Sequence
  Synthetic
gtccgccatg

SEQ ID NO: 222 - DNA, 30 bp, Artificial Sequence
  Synthetic
cccgaaggctacgtccaggagcgcaccatc

SEQ ID NO: 223 - DNA, 10 bp, Artificial Sequence
  Synthetic
ttcttcaagg

SEQ ID NO: 224 - DNA, 10 bp, Artificial Sequence
  Synthetic
gcatcgactt

SEQ ID NO: 225 - DNA, 30 bp, Artificial Sequence
  Synthetic
caaggaggacggcaacatcctggggcacaa

SEQ ID NO: 226 - DNA, 10 bp, Artificial Sequence
  Synthetic
gctggagtac

SEQ ID NO: 227 - DNA, 10 bp, Artificial Sequence
  Synthetic
acggcaacat

SEQ ID NO: 228 - DNA, 30 bp, Artificial Sequence
  Synthetic
cctggggcacaagctggagtacaactacaa

SEQ ID NO: 229 - DNA, 10 bp, Artificial Sequence
  Synthetic
cagccacaac

SEQ ID NO: 230 - DNA, 10 bp, Artificial Sequence
  Synthetic
aagctggagt

SEQ ID NO: 231 - DNA, 30 bp, Artificial Sequence
  Synthetic
acaactacaacagccacaacgtctatatca

SEQ ID NO: 232 - DNA, 10 bp, Artificial Sequence
  Synthetic
tggccgacaa

SEQ ID NO: 233 - DNA, 10 bp, Artificial Sequence
  Synthetic
cgagctgaag

SEQ ID NO: 234 - DNA, 30 bp, Artificial Sequence
  Synthetic
ggcatcgacttcaaggaggacggcaacatc

SEQ ID NO: 235 - DNA, 10 bp, Artificial Sequence
  Synthetic
ctggggcaca

SEQ ID NO: 236 - DNA, 10 bp, Artificial Sequence
  Synthetic
gggcacaagc

SEQ ID NO: 237 - DNA, 30 bp, Artificial Sequence
  Synthetic
tggagtacaactacaacagccacaacgtct

SEQ ID NO: 238 - DNA, 10 bp, Artificial Sequence
  Synthetic
atatcatggc

SEQ ID NO: 239 - DNA, 10 bp, Artificial Sequence
  Synthetic
agccacaacg

SEQ ID NO: 240 - DNA, 30 bp, Artificial Sequence
  Synthetic
tctatatcatggccgacaagcagaagaacg

SEQ ID NO: 241 - DNA, 10 bp, Artificial Sequence
  Synthetic
gcatcaaggt

SEQ ID NO: 242 - DNA, 10 bp, Artificial Sequence
  Synthetic
gcagaagaac

SEQ ID NO: 243 - DNA, 30 bp, Artificial Sequence
  Synthetic
ggcatcaaggtgaacttcaagatccgccac

SEQ ID NO: 244 - DNA, 10 bp, Artificial Sequence
  Synthetic
aacatcgagg

SEQ ID NO: 245 - DNA, 10 bp, Artificial Sequence
  Synthetic
aagatccgcc

SEQ ID NO: 246 - DNA, 30 bp, Artificial Sequence
  Synthetic
acaacatcgaggacggcagcgtgcagctcg

SEQ ID NO: 247 - DNA, 10 bp, Artificial Sequence
  Synthetic
ccgaccacta

SEQ ID NO: 248 - DNA, 10 bp, Artificial Sequence
  Synthetic
cacctacggc

SEQ ID NO: 249 - DNA, 30 bp, Artificial Sequence
  Synthetic
aagctgaccctgaagttcatctgcaccacc

SEQ ID NO: 250 - DNA, 10 bp, Artificial Sequence
  Synthetic
tcgtgaccac

SEQ ID NO: 251 - DNA, 10 bp, Artificial Sequence
  Synthetic
atctgcacca

SEQ ID NO: 252 - DNA, 30 bp, Artificial Sequence
  Synthetic
ccggcaagctgcccgtgccctggcccaccc

SEQ ID NO: 253 - DNA, 10 bp, Artificial Sequence
  Synthetic
tcgtgaccac

SEQ ID NO: 254 - DNA, 10 bp, Artificial Sequence
  Synthetic
tggcccaccc

SEQ ID NO: 255 - DNA, 30 bp, Artificial Sequence
  Synthetic
tcgtgaccaccctgacctacggcgtgcagt

SEQ ID NO: 256 - DNA, 10 bp, Artificial Sequence
  Synthetic
gcttcagccg

SEQ ID NO: 257 - DNA, 10 bp, Artificial Sequence
  Synthetic
tacggcgtgc

SEQ ID NO: 258 - DNA, 30 bp, Artificial Sequence
  Synthetic
agtgcttcagccgctaccccgaccacatga

SEQ ID NO: 259 - DNA, 10 bp, Artificial Sequence
  Synthetic
agcagcacga

SEQ ID NO: 260 - DNA, 30 bp, Artificial Sequence; identical to SEQ ID NO: 228
  Synthetic

SEQ ID NO: 261 - DNA, 30 bp, Artificial Sequence
  Synthetic
cagccacaacgtctatatcatggccgacaa

SEQ ID NO: 262 - DNA, 30 bp, Artificial Sequence
  Synthetic
gcagaagaacggcatcaaggtgaacttcaa

SEQ ID NO: 263 - DNA, 30 bp, Artificial Sequence
  Synthetic
atcgagctgaagggcatcgacttcaaggag

SEQ ID NO: 264 - DNA, 30 bp, Artificial Sequence
  Synthetic
gacggcaacatcctggggcacaagctggag

SEQ ID NO: 265 - DNA, 30 bp, Artificial Sequence
  Synthetic
tacaactacaacagccacaacgtctatatc

SEQ ID NO: 266 - DNA, 30 bp, Artificial Sequence
  Synthetic
aactacaacagccacaacgtctatatcatg

SEQ ID NO: 267 - DNA, 30 bp, Artificial Sequence
  Synthetic
gccgacaagcagaagaacggcatcaaggtg

SEQ ID NO: 268 - DNA, 30 bp, Artificial Sequence
  Synthetic
aacttcaagatccgccacaacatcgaggac

SEQ ID NO: 269 - DNA, 30 bp, Artificial Sequence
  Synthetic
tgaagggcatcgacttcaaggaggacggca

SEQ ID NO: 270 - DNA, 30 bp, Artificial Sequence
  Synthetic
acatcctggggcacaagctggagtacaact

SEQ ID NO: 271 - DNA, 30 bp, Artificial Sequence
  Synthetic
acaacagccacaacgtctatatcatggccg

SEQ ID NO: 272 - DNA, 30 bp, Artificial Sequence; identical to SEQ ID NO: 270
  Synthetic

SEQ ID NO: 273 - DNA, 30 bp, Artificial Sequence; identical to SEQ ID NO: 271
  Synthetic

SEQ ID NO: 274 - DNA, 30 bp, Artificial Sequence
  Synthetic
acaagcagaagaacggcatcaaggtgaact

SEQ ID NO: 275 - DNA, 30 bp, Artificial Sequence
  Synthetic
acgtctatatcatggccgacaagcagaaga

SEQ ID NO: 276 - DNA, 30 bp, Artificial Sequence
  Synthetic
acggcatcaaggtgaacttcaagatccgcc

SEQ ID NO: 277 - DNA, 30 bp, Artificial Sequence; identical to SEQ ID NO: 246
  Synthetic

SEQ ID NO: 278 - DNA, 30 bp, Artificial Sequence
  Synthetic
gcatcgagctgaagggcatcgacttcaagg

SEQ ID NO: 279 - DNA, 30 bp, Artificial Sequence
  Synthetic
aggacggcaacatcctggggcacaagctgg

SEQ ID NO: 280 - DNA, 30 bp, Artificial Sequence
  Synthetic
agtacaactacaacagccacaacgtctata

SEQ ID NO: 281 - DNA, 30 bp, Artificial Sequence
  Synthetic
caactacaacagccacaacgtctatatcat

SEQ ID NO: 282 - DNA, 30 bp, Artificial Sequence
  Synthetic
ggccgacaagcagaagaacggcatcaaggt

SEQ ID NO: 283 - DNA, 30 bp, Artificial Sequence
  Synthetic
gaacttcaagatccgccacaacatcgagga

SEQ ID NO: 284 - DNA, 30 bp, Artificial Sequence
  Synthetic
gtacaactacaacagccacaacgtctatat

SEQ ID NO: 285 - DNA, 30 bp, Artificial Sequence
  Synthetic
catggccgacaagcagaagaacggcatcaa

SEQ ID NO: 286 - DNA, 30 bp, Artificial Sequence
  Synthetic
ggtgaacttcaagatccgccacaacatcga

SEQ ID NO: 287 - DNA, 30 bp, Artificial Sequence
  Synthetic
ggcaacatcctggggcacaagctggagtac

SEQ ID NO: 288 - DNA, 30 bp, Artificial Sequence; identical to SEQ ID NO: 266
  Synthetic

SEQ ID NO: 289 - DNA, 30 bp, Artificial Sequence; identical to SEQ ID NO: 267
  Synthetic

SEQ ID NO: 290 - DNA, 30 bp, Artificial Sequence; identical to SEQ ID NO: 207
  Synthetic

SEQ ID NO: 291 - DNA, 30 bp, Artificial Sequence
  Synthetic
tatcatggccgacaagcagaagaacggcat

SEQ ID NO: 292 - DNA, 30 bp, Artificial Sequence
  Synthetic
caaggtgaacttcaagatccgccacaacat

SEQ ID NO: 293 - DNA, 30 bp, Artificial Sequence
  Synthetic
caagcagaagaacggcatcaaggtgaactt

SEQ ID NO: 294 - DNA, 30 bp, Artificial Sequence
  Synthetic
caagatccgccacaacatcgaggacggcag

SEQ ID NO: 295 - DNA, 30 bp, Artificial Sequence
  Synthetic
cgtgcagctcgccgaccactaccagcagaa

SEQ ID NO: 296 - DNA, 30 bp, Artificial Sequence
  Synthetic
aagaacggcatcaaggtgaacttcaagatc

SEQ ID NO: 297 - DNA, 30 bp, Artificial Sequence
  Synthetic
cgccacaacatcgaggacggcagcgtgcag

SEQ ID NO: 298 - DNA, 30 bp, Artificial Sequence
  Synthetic
ctcgccgaccactaccagcagaacaccccc

SEQ ID NO: 299 - DNA, 30 bp, Artificial Sequence
  Synthetic
tacaacagccacaacgtctatatcatggcc

SEQ ID NO: 300 - DNA, 30 bp, Artificial Sequence
  Synthetic
gacaagcagaagaacggcatcaaggtgaac

SEQ ID NO: 301 - DNA, 30 bp, Artificial Sequence
  Synthetic
ttcaagatccgccacaacatcgaggacggc

SEQ ID NO: 302 - DNA, 30 bp, Artificial Sequence
  Synthetic
agctggagtacaactacaacagccacaacg

SEQ ID NO: 303 - DNA, 30 bp, Artificial Sequence; identical to SEQ ID NO: 240
  Synthetic

SEQ ID NO: 304 - DNA, 30 bp, Artificial Sequence
  Synthetic
gcatcaaggtgaacttcaagatccgccaca

SEQ ID NO: 305 - DNA, 30 bp, Artificial Sequence
  Synthetic
acggcaacatcctggggcacaagctggagt

SEQ ID NO: 306 - DNA, 30 bp, Artificial Sequence; identical to SEQ ID NO: 231
  Synthetic

SEQ ID NO: 307 - DNA, 30 bp, Artificial Sequence
  Synthetic
tggccgacaagcagaagaacggcatcaagg

SEQ ID NO: 308 - DNA, 30 bp, Artificial Sequence
  Synthetic
tatatcatggccgacaagcagaagaacggc

SEQ ID NO: 309 - DNA, 30 bp, Artificial Sequence
  Synthetic
atcaaggtgaacttcaagatccgccacaac

SEQ ID NO: 310 - DNA, 30 bp, Artificial Sequence
  Synthetic
atcgaggacggcagcgtgcagctcgccgac

SEQ ID NO: 311 - DNA, 30 bp, Artificial Sequence; identical to SEQ ID NO: 237
  Synthetic

SEQ ID NO: 312 - DNA, 30 bp, Artificial Sequence
  Synthetic
atatcatggccgacaagcagaagaacggca

SEQ ID NO: 313 - DNA, 30 bp, Artificial Sequence
  Synthetic
tcaaggtgaacttcaagatccgccacaaca

SEQ ID NO: 314 - DNA, 30 bp, Artificial Sequence
  Synthetic
gcaacatcctggggcacaagctggagtaca

SEQ ID NO: 315 - DNA, 30 bp, Artificial Sequence
  Synthetic
actacaacagccacaacgtctatatcatgg

SEQ ID NO: 316 - DNA, 30 bp, Artificial Sequence
  Synthetic
ccgacaagcagaagaacggcatcaaggtga

SEQ ID NO: 317 - DNA, 30 bp, Artificial Sequence
  Synthetic
ttcaaggaggacggcaacatcctggggcac

SEQ ID NO: 318 - DNA, 30 bp, Artificial Sequence
  Synthetic
aagctggagtacaactacaacagccacaac

SEQ ID NO: 319 - DNA, 30 bp, Artificial Sequence
  Synthetic
gtctatatcatggccgacaagcagaagaac

SEQ ID NO: 320 - DNA, 30 bp, Artificial Sequence
  Synthetic
gacctacggcgtgcagtgcttcagccgcta

SEQ ID NO: 321 - DNA, 30 bp, Artificial Sequence
  Synthetic
ccccgaccacatgaagcagcacgacttctt

SEQ ID NO: 322 - DNA, 30 bp, Artificial Sequence
  Synthetic
caagtccgccatgcccgaaggctacgtcca

SEQ ID NO: 323 - DNA, 30 bp, Artificial Sequence
  Synthetic
gaccaccctgacctacggcgtgcagtgctt

SEQ ID NO: 324 - DNA, 30 bp, Artificial Sequence
  Synthetic
cagccgctaccccgaccacatgaagcagca

SEQ ID NO: 325 - DNA, 30 bp, Artificial Sequence
  Synthetic
cgacttcttcaagtccgccatgcccgaagg

SEQ ID NO: 326 - DNA, 30 bp, Artificial Sequence
  Synthetic
ttcatctgcaccaccggcaagctgcccgtg

SEQ ID NO: 327 - DNA, 30 bp, Artificial Sequence
  Synthetic
ccctggcccaccctcgtgaccaccctgacc

SEQ ID NO: 328 - DNA, 30 bp, Artificial Sequence
  Synthetic
tacggcgtgcagtgcttcagccgctacccc

SEQ ID NO: 329 - DNA, 30 bp, Artificial Sequence
  Synthetic
cttcagccgctaccccgaccacatgaagca

SEQ ID NO: 330 - DNA, 30 bp, Artificial Sequence
  Synthetic
gcacgacttcttcaagtccgccatgcccga

SEQ ID NO: 331 - DNA, 30 bp, Artificial Sequence
  Synthetic
aggctacgtccaggagcgcaccatcttctt

SEQ ID NO: 332 - DNA, 30 bp, Artificial Sequence
  Synthetic
ggcccaccctcgtgaccaccctgacctacg

SEQ ID NO: 333 - DNA, 30 bp, Artificial Sequence
  Synthetic
gcgtgcagtgcttcagccgctaccccgacc

SEQ ID NO: 334 - DNA, 30 bp, Artificial Sequence
  Synthetic
acatgaagcagcacgacttcttcaagtccg

SEQ ID NO: 335 - DNA, 30 bp, Artificial Sequence
  Synthetic
ccgctaccccgaccacatgaagcagcacga

SEQ ID NO: 336 - DNA, 30 bp, Artificial Sequence
  Synthetic
cttcttcaagtccgccatgcccgaaggcta

SEQ ID NO: 337 - DNA, 30 bp, Artificial Sequence
  Synthetic
cgtccaggagcgcaccatcttcttcaagga

SEQ ID NO: 338 - DNA, 30 bp, Artificial Sequence
  Synthetic
caagctgcccgtgccctggcccaccctcgt

SEQ ID NO: 339 - DNA, 30 bp, Artificial Sequence; identical to SEQ ID NO: 323
  Synthetic

SEQ ID NO: 340 - DNA, 30 bp, Artificial Sequence; identical to SEQ ID NO: 324
  Synthetic

SEQ ID NO: 341 - DNA, 30 bp, Artificial Sequence
  Synthetic
accctcgtgaccaccctgacctacggcgtg

SEQ ID NO: 342 - DNA, 30 bp, Artificial Sequence
  Synthetic
cagtgcttcagccgctaccccgaccacatg

SEQ ID NO: 343 - DNA, 30 bp, Artificial Sequence
  Synthetic
aagcagcacgacttcttcaagtccgccatg

SEQ ID NO: 344 - DNA, 30 bp, Artificial Sequence
  Synthetic
acggcaagctgaccctgaagttcatctgca

SEQ ID NO: 345 - DNA, 30 bp, Artificial Sequence
  Synthetic
ccaccggcaagctgcccgtgccctggccca

SEQ ID NO: 346 - DNA, 30 bp, Artificial Sequence
  Synthetic
ccctcgtgaccaccctgacctacggcgtgc

SEQ ID NO: 347 - DNA, 30 bp, Artificial Sequence
  Synthetic
gaccctgaagttcatctgcaccaccggcaa

SEQ ID NO: 348 - DNA, 30 bp, Artificial Sequence
  Synthetic
gctgcccgtgccctggcccaccctcgtgac

SEQ ID NO: 349 - DNA, 30 bp, Artificial Sequence
  Synthetic
caccctgacctacggcgtgcagtgcttcag

SEQ ID NO: 350 - DNA, 30 bp, Artificial Sequence
  Synthetic
gcagtgcttcagccgctaccccgaccacat

SEQ ID NO: 351 - DNA, 30 bp, Artificial Sequence
  Synthetic
gaagcagcacgacttcttcaagtccgccat

SEQ ID NO: 352 - DNA, 30 bp, Artificial Sequence
  Synthetic
gcccgaaggctacgtccaggagcgcaccat

SEQ ID NO: 353 - DNA, 30 bp, Artificial Sequence
  Synthetic
gccctggcccaccctcgtgaccaccctgac

SEQ ID NO: 354 - DNA, 30 bp, Artificial Sequence
  Synthetic
ctacggcgtgcagtgcttcagccgctaccc

SEQ ID NO: 355 - DNA, 30 bp, Artificial Sequence
  Synthetic
cgaccacatgaagcagcacgacttcttcaa

SEQ ID NO: 356 - DNA, 30 bp, Artificial Sequence; identical to SEQ ID NO: 349
  Synthetic

SEQ ID NO: 357 - DNA, 30 bp, Artificial Sequence; identical to SEQ ID NO: 335
  Synthetic

SEQ ID NO: 358 - DNA, 30 bp, Artificial Sequence; identical to SEQ ID NO: 336
  Synthetic

SEQ ID NO: 359 - DNA, 30 bp, Artificial Sequence
  Synthetic
accaccctgacctacggcgtgcagtgcttc

SEQ ID NO: 360 - DNA, 30 bp, Artificial Sequence
  Synthetic
agccgctaccccgaccacatgaagcagcac

SEQ ID NO: 361 - DNA, 30 bp, Artificial Sequence
  Synthetic
gacttcttcaagtccgccatgcccgaaggc

SEQ ID NO: 362 - DNA, 30 bp, Artificial Sequence
  Synthetic
gctaccccgaccacatgaagcagcacgact

SEQ ID NO: 363 - DNA, 30 bp, Artificial Sequence
  Synthetic
tcttcaagtccgccatgcccgaaggctacg

SEQ ID NO: 364 - DNA, 30 bp, Artificial Sequence
  Synthetic
tccaggagcgcaccatcttcttcaaggacg

SEQ ID NO: 365 - DNA, 30 bp, Artificial Sequence
  Synthetic
atgaagcagcacgacttcttcaagtccgcc

SEQ ID NO: 366 - DNA, 30 bp, Artificial Sequence
  Synthetic
atgcccgaaggctacgtccaggagcgcacc

SEQ ID NO: 367 - DNA, 30 bp, Artificial Sequence
  Synthetic
atcttcttcaaggacgacggcaactacaag

SEQ ID NO: 368 - DNA, 30 bp, Artificial Sequence
  Synthetic
gcaccaccggcaagctgcccgtgccctggc

SEQ ID NO: 369 - DNA, 30 bp, Artificial Sequence
  Synthetic
ccaccctcgtgaccaccctgacctacggcg

SEQ ID NO: 370 - DNA, 30 bp, Artificial Sequence
  Synthetic
tgcagtgcttcagccgctaccccgaccaca

SEQ ID NO: 371 - DNA, 30 bp, Artificial Sequence
  Synthetic
tgcaccaccggcaagctgcccgtgccctgg

SEQ ID NO: 372 - DNA, 30 bp, Artificial Sequence
  Synthetic
cccaccctcgtgaccaccctgacctacggc

SEQ ID NO: 373 - DNA, 30 bp, Artificial Sequence
  Synthetic
gtgcagtgcttcagccgctaccccgaccac

SEQ ID NO: 374 - DNA, 30 bp, Artificial Sequence
  Synthetic
accctgacctacggcgtgcagtgcttcagc

SEQ ID NO: 375 - DNA, 30 bp, Artificial Sequence
  Synthetic
cgctaccccgaccacatgaagcagcacgac

SEQ ID NO: 376 - DNA, 30 bp, Artificial Sequence
  Synthetic
ttcttcaagtccgccatgcccgaaggctac

SEQ ID NO: 377 - DNA, 30 bp, Artificial Sequence
  Synthetic
ccacctacggcaagctgaccctgaagttca

SEQ ID NO: 378 - DNA, 30 bp, Artificial Sequence
  Synthetic
tctgcaccaccggcaagctgcccgtgccct

SEQ ID NO: 379 - DNA, 30 bp, Artificial Sequence; identical to SEQ ID NO: 332
  Synthetic

SEQ ID NO: 380 - protein, 1150 aa, Artificial Sequence
  Synthetic
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 381 - protein, 1150 aa, Flavobacterium branchiophilum; identical to SEQ ID NO: 380

SEQ ID NO: 382 - protein, 1132 aa, Artificial Sequence
  Synthetic
KIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKK

SEQ ID NO: 383 - protein, 1137 aa, Paludibacter propionicigenes
KIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 384 - protein, 634 aa, Artificial Sequence
  Synthetic
LVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEE

SEQ ID NO: 385 - protein, 632 aa, Bacteroides coprosuis
LWSKYSRKQDKFMLYASRYLAESNYFGEEAMFKVYQFASNEEQEKYIVEAKQNLPKREYDKLKYHKGRLVVYKSYHNHLQEYPRWDYPFVVENNAIQIYVKILGEPWIVSIQRRLIIYFLEDALFSKKKESNGIALLQNYLPHHQRDVRNGLFVFKTGQTNNLSTKEMSNLRKLFPRKLIQSYLYEDNTGDMDSPSQVLSDTSINDTEKKGTKKILNLRVGKHLKLRYIRKVWNLIYFKDIYKDKAQRMGHHKKFHITKDEFVFYTRWMYSFESIPSYKDHLIQFFIKKHFFNNEEFKELFLNSSSIDELYLQTKRNFIKWSAHNVNSEKKEKTYSLEDYKLFFESKILYINVSHFISFLNQEKVIQKNDNGIIQYKALKNLSYLIKPFYYKDKLEIEHYKTYGKVFNKLRSIKLEDCLLYEIAYRYLLNVTPSFPKYKQLIIQSFPKEKVDLLVNAIYSFEIHNKKGAFIYSIQVPFLKLNELVCLIYRNSTKIAATNKEFLFLQIYKYLVNYCKNKPVDYELYTVCYKFNQLKVLGYDDLLHFLKHIVKRGLQLTQILTQLEKFLIIKNNIQIDIQKQGTLNSLSIYECSKMNNPQKLEDLRIKAINFDIPDTDYPSILEHIEKQFIIKE

SEQ ID NO: 386 - protein, 622 aa, Artificial Sequence
  Synthetic
MDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEE

SEQ ID NO: 387 - protein, 620 aa, Bacteroides coprosuis
MLYASRYLAESNYFGEEAMFKVYQFASNEEQEKYIVEAKQNLPKREYDKLKYHKGRLVVYKSYHNHLQEYPRWDYPFVVENNAIQIYVKILGEPWIVSIQRRLIIYFLEDALFSKKKESNGIALLQNYLPHHQRDVRNGLFVFKTGQTNNLSTKEMSNLRKLFPRKLIQSYLYEDNTGDMDSPSQVLSDTSINDTEKKGTKKILNLRVGKHLKLRYIRKVWNLIYFKDIYKDKAQRMGHHKKFHITKDEFVFYTRWMYSFESIPSYKDHLIQFFIKKHFFNNEEFKELFLNSSSIDELYLQTKRNFIKWSAHNVNSEKKEKTYSLEDYKLFFESKILYINVSHFISFLNQEKVIQKNDNGIIQYKALKNLSYLIKPFYYKDKLEIEHYKTYGKVFNKLRSIKLEDCLLYEIAYRYLLNVTPSFPKYKQLIIQSFPKEKVDLLVNAIYSFEIHNKKGAFIYSIQVPFLKLNELVCLIYRNSTKIAATNKEFLFLQIYKYLVNYCKNKPVDYELYTVCYKFNQLKVLGYDDLLHFLKHIVKRGLQLTQILTQLEKFLIIKNNIQIDIQKQGTLNSLSIYECSKMNNPQKLEDLRIKAINFDIPDTDYPSILEHIEKQFIIKE

SEQ ID NO: 388 - protein, 301 aa, Artificial Sequence
  Synthetic
KGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELN

SEQ ID NO: 389 - protein, 325 aa, Bacteroides coprosuis
KGLLAPLSEIAYRNFELVCDNNEKSGDLSLQAISSIYQFSIGQTFKSHNIKQLFNYQLNDEKDRFVPTKYLSLQKKQFIDNEIASTLLKLVSAIRELNQNYTHNLEPLRIGNNIITPQIIEFLHDLFEVSIIMLLNKSVKDRNNFTSQYNEDSLNLLLKEFILTLFFPETSYTTEEIEVLRKKSKDELINEVLFFDVQSVYQWKVVNNPLMMPIQCGKYLSFTSCLFINSLFLFKEDTKIIFPNFPFLKNKTDETQVLQMFFSLFANPYTLHYIPSQHLRIAKHKDIIEYLNLYPSPWQEALNSQSPCFPMSHLLKDFLIERECN

SEQ ID NO: 390 - DNA, 36 bp, Finegoldia magna
gtttaatacctatatgaaattacatcattctcaaac

SEQ ID NO: 391 - DNA, 36 bp, Porphyromonas gingivalis
gttgtctccacccttctaactaagggtattcccaac

SEQ ID NO: 392 - DNA, 37 bp, Porphyromonas gingivalis
gtcttaatagccttacggactgtgtatgtatagtgag

SEQ ID NO: 393 - DNA, 30 bp, Porphyromonas gingivalis
gttttaattcctgtatggtgcaattgaaat

SEQ ID NO: 394 - DNA, 36 bp, Porphyromonas gingivalis; identical to SEQ ID NO: 391

SEQ ID NO: 395 - DNA, 37 bp, Porphyromonas gingivalis; identical to SEQ ID NO: 392

SEQ ID NO: 396 - DNA, 30 bp, Porphyromonas gingivalis; identical to SEQ ID NO: 393

SEQ ID NO: 397 - DNA, 36 bp, Riemerella anatipestifer
gttgtgaatacccttcaaagtgagagcagtcccaac

SEQ ID NO: 398 - DNA, 37 bp, Riemerella anatipestifer
gttgtgaatacccttcaaaatgagagcagtcccaact

SEQ ID NO: 399 - DNA, 47 bp, Riemerella anatipestifer
gttgtgaattgctttcaatttttactatctttgtgatagttcgcaac

SEQ ID NO: 400 - DNA, 49 bp, Riemerella anatipestifer
gttgcgaactatcacaaagatagtaaaaattgaaagcaattcacaactt

SEQ ID NO: 401 - DNA, 47 bp, Riemerella anatipestifer
gttgcgaattatcacaaagatagtgaaaattgaaagcaattcacaac

SEQ ID NO: 402 - DNA, 36 bp, Riemerella anatipestifer
gttgggactgctctcattttgaagggtattcacaac

SEQ ID NO: 403 - DNA, 36 bp, Capnocytophaga canimorsus
gttgtgattaccctccaaaatgagagcagttccaac

SEQ ID NO: 404 - DNA, 37 bp, Capnocytophaga canimorsus
cgttgtgattaccctccaaaatgagagcagttccaac

SEQ ID NO: 405 - DNA, 36 bp, Capnocytophaga canimorsus; identical to SEQ ID NO: 403

SEQ ID NO: 406 - DNA, 36 bp, Capnocytophaga canimorsus; identical to SEQ ID NO: 403

SEQ ID NO: 407 - DNA, 47 bp, Capnocytophaga canimorsus
gttgtaaattgctttcaattttccgtaactttgtgattagttacaac

SEQ ID NO: 408 - DNA, 47 bp, Capnocytophaga canimorsus; identical to SEQ ID NO: 407

SEQ ID NO: 409 - DNA, 38 bp, Flavobacterium columnare
gttgtggtttgattaaagattagaaaacacgatattat

SEQ ID NO: 410 - DNA, 36 bp, Flavobacterium columnare
gttgtggtttgattaaagattagaaaacacgatatt

SEQ ID NO: 411 - DNA, 36 bp, Flavobacterium columnare
gttgggaaagcccttattttgaagggtatctacaac

SEQ ID NO: 412 - DNA, 47 bp, Riemerella anatipestifer; identical to SEQ ID NO: 399

SEQ ID NO: 413 - DNA, 36 bp, Riemerella anatipestifer; identical to SEQ ID NO: 397

SEQ ID NO: 414 - DNA, 36 bp, Prevotella intermedia
gttgtttttaccttgcaaacagcaggcagatgcaac

SEQ ID NO: 415 - DNA, 46 bp, Psychroflexus torquis
cctgtgaattatcactaaaaatacaattttgaaagcaattcacaac

SEQ ID NO: 416 - DNA, 47 bp, Psychroflexus torquis
cctgtgaattatcactaaaaatacaattttgaaagcaattcacaacc

SEQ ID NO: 417 - DNA, 36 bp, Psychroflexus torquis
gttgtaactgcccttattttgaagggtaaacacaac

SEQ ID NO: 418 - DNA, 36 bp, Psychroflexus torquis
gttgtaactgcccttattttgaagggtaaacacagc

SEQ ID NO: 419 - DNA, 40 bp, Psychroflexus torquis
ttgtggctgtgaggccctgaaataaattcagggtgataag

SEQ ID NO: 420 - DNA, 47 bp, Riemerella anatipestifer
gttgcgaactatcacaaagatagtaaaaattgaaagcaattcacaac

SEQ ID NO: 421 - DNA, 36 bp, Riemerella anatipestifer
gttgggactgctctcactttgaagggtattcacaac

SEQ ID NO: 422 - DNA, 47 bp, Riemerella anatipestifer; identical to SEQ ID NO: 420

SEQ ID NO: 423 - DNA, 36 bp, Riemerella anatipestifer; identical to SEQ ID NO: 421

SEQ ID NO: 424 - DNA, 30 bp, Porphyromonas gingivalis; identical to SEQ ID NO: 393

SEQ ID NO: 425 - DNA, 36 bp, Porphyromonas gingivalis
gttgggaatacccttagttagaagggtggagacaac

SEQ ID NO: 426 - DNA, 36 bp, Porphyromonas gingivalis
gttgtgtgtacccttcgaatagagggtagatccaac

SEQ ID NO: 427 - DNA, 30 bp, Porphyromonas gingivalis; identical to SEQ ID NO: 393

SEQ ID NO: 428 - DNA, 36 bp, Porphyromonas gingivalis; identical to SEQ ID NO: 425

SEQ ID NO: 429 - DNA, 36 bp, Porphyromonas gingivalis; identical to SEQ ID NO: 426

SEQ ID NO: 430 - DNA, 47 bp, Riemerella anatipestifer; identical to SEQ ID NO: 399

SEQ ID NO: 431 - DNA, 36 bp, Riemerella anatipestifer
gttgtgaatacccttcaaaatgagagcagtcccaac

SEQ ID NO: 432 - DNA, 47 bp, Riemerella anatipestifer; identical to SEQ ID NO: 399

SEQ ID NO: 433 - DNA, 36 bp, Riemerella anatipestifer; identical to SEQ ID NO: 397

SEQ ID NO: 434 - DNA, 47 bp, Riemerella anatipestifer; identical to SEQ ID NO: 399

SEQ ID NO: 435 - DNA, 36 bp, Riemerella anatipestifer; identical to SEQ ID NO: 397

SEQ ID NO: 436 - DNA, 47 bp, Riemerella anatipestifer
gttgtgaattgctttcaattttcactatctttgtgataattcgcaac

SEQ ID NO: 437 - DNA, 36 bp, Riemerella anatipestifer; identical to SEQ ID NO: 431

SEQ ID NO: 438 - DNA, 37 bp, Porphyromonas gingivalis; identical to SEQ ID NO: 392

SEQ ID NO: 439 - DNA, 39 bp, Porphyromonas gingivalis
agtcttaatagccttacggactgtgtatgtatagtgagt

SEQ ID NO: 440 - DNA, 35 bp, Porphyromonas gingivalis
ttgggaatacccttagttagaagggtggagacaac

SEQ ID NO: 441 - DNA, 36 bp, Porphyromonas gingivalis; identical to SEQ ID NO: 426

SEQ ID NO: 442 - DNA, 30 bp, Porphyromonas gingivalis; identical to SEQ ID NO: 393

SEQ ID NO: 443 - DNA, 37 bp, Porphyromonas gingivalis; identical to SEQ ID NO: 392

SEQ ID NO: 444 - DNA, 39 bp, Porphyromonas gingivalis; identical to SEQ ID NO: 439

SEQ ID NO: 445 - DNA, 35 bp, Porphyromonas gingivalis; identical to SEQ ID NO: 440

SEQ ID NO: 446 - DNA, 36 bp, Porphyromonas gingivalis; identical to SEQ ID NO: 426

SEQ ID NO: 447 - DNA, 30 bp, Porphyromonas gingivalis; identical to SEQ ID NO: 393

SEQ ID NO: 448 - DNA, 36 bp, Porphyromonas gingivalis; identical to SEQ ID NO: 391

SEQ ID NO: 449 - DNA, 36 bp, Porphyromonas gingivalis; identical to SEQ ID NO: 426

SEQ ID NO: 450 - DNA, 30 bp, Porphyromonas gingivalis; identical to SEQ ID NO: 393

SEQ ID NO: 451 - DNA, 36 bp, Porphyromonas gingivalis; identical to SEQ ID NO: 391

SEQ ID NO: 452 - DNA, 36 bp, Porphyromonas gingivalis; identical to SEQ ID NO: 426

SEQ ID NO: 453 - DNA, 30 bp, Porphyromonas gingivalis; identical to SEQ ID NO: 393

SEQ ID NO: 454 - DNA, 30 bp, Porphyromonas gingivalis; identical to SEQ ID NO: 393

SEQ ID NO: 455 - DNA, 30 bp, Porphyromonas gingivalis; identical to SEQ ID NO: 393

SEQ ID NO: 456 - DNA, 29 bp, Porphyromonas gingivalis
ttttaattcctgtatggtgcaattgaaat

SEQ ID NO: 457 - DNA, 37 bp, Porphyromonas gingivalis; identical to SEQ ID NO: 392

SEQ ID NO: 458 - DNA, 37 bp, Porphyromonas gingivalis
gttggatctaccctctattcgaagggtacacacaaca

SEQ ID NO: 459 - DNA, 36 bp, Prevotella intermedia; identical to SEQ ID NO: 414

SEQ ID NO: 460 - DNA, 36 bp, Capnocytophaga cynodegmi
gttggaactgctctcattttggagggtaatcacaac

SEQ ID NO: 461 - DNA, 36 bp, Capnocytophaga canimorsus
gttatgattaccctccaaaatgagagcagttccaac

SEQ ID NO: 462 - DNA, 36 bp, Prevotella buccae
gttgcatctgccttctttttgaaaggtaaaaacaac

SEQ ID NO: 463 - DNA, 36 bp, Riemerella anatipestifer; identical to SEQ ID NO: 402

SEQ ID NO: 464 - DNA, 36 bp, Prevotella buccae; identical to SEQ ID NO: 462

SEQ ID NO: 465 - DNA, 36 bp, Prevotella pallens; identical to SEQ ID NO: 414

SEQ ID NO: 466 - DNA, 38 bp, Myroides odoratimimus
gttgtgattgcacaccaaaaacgtgtacagtaccaaca

SEQ ID NO: 467 - DNA, 36 bp, Porphyromonas gingivalis
gttggatctaccctctattcgaagggtacacacaac

SEQ ID NO: 468 - DNA, 36 bp, Porphyromonas gingivalis; identical to SEQ ID NO: 391

SEQ ID NO: 469 - DNA, 36 bp, Prevotella sp; identical to SEQ ID NO: 462

SEQ ID NO: 470 - DNA, 36 bp, Bergeyella zoohelcum; identical to SEQ ID NO: 403

SEQ ID NO: 471 - DNA, 36 bp, Porphyromonas gingivalis; identical to SEQ ID NO: 467

SEQ ID NO: 472 - DNA, 36 bp, Porphyromonas gingivalis; identical to SEQ ID NO: 467

SEQ ID NO: 473 - DNA, 36 bp, Porphyromonas gingivalis; identical to SEQ ID NO: 391

SEQ ID NO: 474 - DNA, 36 bp, Porphyromonas gingivalis; identical to SEQ ID NO: 467

SEQ ID NO: 475 - DNA, 37 bp, Porphyromonas gingivalis
gttgtctccacccttctaactaagggtattcccaaca

SEQ ID NO: 476 - DNA, 36 bp, Porphyromonas gingivalis; identical to SEQ ID NO: 426

SEQ ID NO: 477 - DNA, 37 bp, Porphyromonas gingivalis
gttgtctccacccttctaactaagggtattcccaacg

SEQ ID NO: 478 - DNA, 36 bp, Prevotella pleuritidis
gttgtttgtgcctctcaaatagaaggcagatgcaac

SEQ ID NO: 479 - DNA, 36 bp, Porphyromonas gingivalis; identical to SEQ ID NO: 425

SEQ ID NO: 480 - DNA, 36 bp, Bacteroides pyogenes
gttgtggatgccactagtttgagtggtatagacaac

SEQ ID NO: 481 - DNA, 36 bp, Phaeodactylibacter xiamenensis
gtcggagaggcctctggctcgagaggtgactacgac

SEQ ID NO: 482 - DNA, 36 bp, Phaeodactylibacter xiamenensis; identical to SEQ ID NO: 30

SEQ ID NO: 483 - DNA, 37 bp, Porphyromonas gulae; identical to SEQ ID NO: 392

SEQ ID NO: 484 - DNA, 30 bp, Porphyromonas gulae; identical to SEQ ID NO: 393

SEQ ID NO: 485 - DNA, 36 bp, Porphyromonas gulae
gttgtgtgtacccttcaaatagagggtagatccaac

SEQ ID NO: 486 - DNA, 36 bp, Porphyromonas sp; identical to SEQ ID NO: 485

SEQ ID NO: 487 - DNA, 42 bp, Porphyromonas gulae
tcatgttgtgtgtacccttcaaatagagggtagatccaacct

SEQ ID NO: 488 - DNA, 36 bp, Porphyromonas gulae; identical to SEQ ID NO: 485

SEQ ID NO: 489 - DNA, 36 bp, Porphyromonas gulae; identical to SEQ ID NO: 425

SEQ ID NO: 490 - DNA, 36 bp, Porphyromonas gulae; identical to SEQ ID NO: 426

SEQ ID NO: 491 - DNA, 36 bp, Porphyromonas gulae; identical to SEQ ID NO: 485

SEQ ID NO: 492 - DNA, 36 bp, Porphyromonas gulae; identical to SEQ ID NO: 485

SEQ ID NO: 493 - DNA, 36 bp, Porphyromonas gulae
gttggatctaccctctatttgaagggtacacacaac

SEQ ID NO: 494 - DNA, 37 bp, Prevotella sp
ctccgagagcatggtccactaaaacaaggattaagac

SEQ ID NO: 495 - DNA, 20 bp, Prevotella sp
gttgtaatagtccctcaaaa

SEQ ID NO: 496 - DNA, 36 bp, Prevotella sp
gttgtaatagcccctcaaaaccggaccttccacaac

SEQ ID NO: 497 - DNA, 36 bp, Prevotella sp
gttgtaatagcccctcaaaactggaccttccacaac

SEQ ID NO: 498 - DNA, 42 bp, Prevotella intermedia
aaagatgttgtttttaccttgcaaacagcaggcagatgcaac

SEQ ID NO: 499 - DNA, 36 bp, Porphyromonas gulae; identical to SEQ ID NO: 493

SEQ ID NO: 500 - DNA, 29 bp, Bergeyella zoohelcum
attctaatcgcaccataaggaattgaaac

SEQ ID NO: 501 - DNA, 36 bp, Bergeyella zoohelcum; identical to SEQ ID NO: 403

SEQ ID NO: 502 - DNA, 36 bp, Prevotella buccae; identical to SEQ ID NO: 462

SEQ ID NO: 503 - DNA, 36 bp, Prevotella buccae; identical to SEQ ID NO: 462

SEQ ID NO: 504 - DNA, 47 bp, Prevotella buccae
gttgttgttgctaccacaaaggtacaaattttcaagcaaatcacaac

SEQ ID NO: 505 - DNA, 36 bp, Riemerella anatipestifer; identical to SEQ ID NO: 397

SEQ ID NO: 506 - DNA, 37 bp, Riemerella anatipestifer; identical to SEQ ID NO: 398

SEQ ID NO: 507 - DNA, 47 bp, Riemerella anatipestifer; identical to SEQ ID NO: 399

SEQ ID NO: 508 - DNA, 36 bp, Porphyromonas gingivalis; identical to SEQ ID NO: 391

SEQ ID NO: 509 - DNA, 37 bp, Porphyromonas gingivalis; identical to SEQ ID NO: 392

SEQ ID NO: 510 - DNA, 30 bp, Porphyromonas gingivalis; identical to SEQ ID NO: 393

SEQ ID NO: 511 - DNA, 38 bp, Prevotella pallens
gtcttaatccttgttgtaatggaatatacttaataatt

SEQ ID NO: 512 - DNA, 36 bp, Prevotella pallens; identical to SEQ ID NO: 414

SEQ ID NO: 513 - DNA, 40 bp, Myroides odoratimimus
tgttgtgattgcacaccaaatacgtgtacagtaccaacgt

SEQ ID NO: 514 - DNA, 38 bp, Myroides odoratimimus; identical to SEQ ID NO: 466

SEQ ID NO: 515 - DNA, 30 bp, Myroides odoratimimus
atttcaatacctatatggtgcagttaaaag

SEQ ID NO: 516 - DNA, 30 bp, Myroides odoratimimus; identical to SEQ ID NO: 515

SEQ ID NO: 517 - DNA, 36 bp, Prevotella sp; identical to SEQ ID NO: 462

SEQ ID NO: 518 - DNA, 36 bp, Porphyromonas gingivalis; identical to SEQ ID NO: 391

SEQ ID NO: 519 - DNA, 36 bp, Porphyromonas gingivalis; identical to SEQ ID NO: 426

SEQ ID NO: 520 - DNA, 30 bp, Porphyromonas gingivalis; identical to SEQ ID NO: 393

SEQ ID NO: 521 - DNA, 36 bp, Porphyromonas gingivalis; identical to SEQ ID NO: 391

SEQ ID NO: 522 - DNA, 36 bp, Porphyromonas gingivalis; identical to SEQ ID NO: 426

SEQ ID NO: 523 - DNA, 30 bp, Porphyromonas gingivalis; identical to SEQ ID NO: 393

SEQ ID NO: 524 - DNA, 30 bp, Porphyromonas gingivalis; identical to SEQ ID NO: 393

SEQ ID NO: 525 - DNA, 30 bp, Porphyromonas gingivalis; identical to SEQ ID NO: 393

SEQ ID NO: 526 - DNA, 29 bp, Porphyromonas gingivalis
ttttaattcctgtatggtgcaattgaaat

SEQ ID NO: 527 - DNA, 37 bp, Porphyromonas gingivalis; identical to SEQ ID NO: 392

SEQ ID NO: 528 - DNA, 37 bp, Porphyromonas gingivalis; identical to SEQ ID NO: 458

SEQ ID NO: 529 - DNA, 36 bp, Capnocytophaga canimorsus; identical to SEQ ID NO: 403

SEQ ID NO: 530 - DNA, 37 bp, Capnocytophaga canimorsus; identical to SEQ ID NO: 404

SEQ ID NO: 531 - DNA, 36 bp, Capnocytophaga canimorsus; identical to SEQ ID NO: 403

SEQ ID NO: 532 - DNA, 36 bp, Capnocytophaga canimorsus; identical to SEQ ID NO: 403

SEQ ID NO: 533 - DNA, 47 bp, Capnocytophaga canimorsus; identical to SEQ ID NO: 407

SEQ ID NO: 534 - DNA, 47 bp, Capnocytophaga canimorsus; identical to SEQ ID NO: 407

SEQ ID NO: 535 - DNA, 38 bp, Flavobacterium columnare; identical to SEQ ID NO: 409

SEQ ID NO: 536 - DNA, 36 bp, Flavobacterium columnare; identical to SEQ ID NO: 410

SEQ ID NO: 537 - DNA, 36 bp, Flavobacterium columnare; identical to SEQ ID NO: 411

SEQ ID NO: 538 - DNA, 46 bp, Psychroflexus torquis; identical to SEQ ID NO: 415

SEQ ID NO: 539 - DNA, 47 bp, Psychroflexus torquis; identical to SEQ ID NO: 416

SEQ ID NO: 540 - DNA, 36 bp, Psychroflexus torquis; identical to SEQ ID NO: 417

SEQ ID NO: 541 - DNA, 36 bp, Psychroflexus torquis; identical to SEQ ID NO: 418

SEQ ID NO: 542 - DNA, 40 bp, Psychroflexus torquis; identical to SEQ ID NO: 419

SEQ ID NO: 543 - DNA, 47 bp, Riemerella anatipestifer; identical to SEQ ID NO: 420

SEQ ID NO: 544 - DNA, 36 bp, Riemerella anatipestifer; identical to SEQ ID NO: 421

SEQ ID NO: 545 - DNA, 47 bp, Riemerella anatipestifer; identical to SEQ ID NO: 420

SEQ ID NO: 546 - DNA, 36 bp, Riemerella anatipestifer; identical to SEQ ID NO: 421

SEQ ID NO: 547 - DNA, 36 bp, Prevotella pleuritidis; identical to SEQ ID NO: 478

SEQ ID NO: 548 - DNA, 37 bp, Porphyromonas gingivalis
agttgtctccacccttctaactaagggtattcccaac

SEQ ID NO: 549 - DNA, 36 bp, Porphyromonas gingivalis; identical to SEQ ID NO: 391

SEQ ID NO: 550 - DNA, 37 bp, Porphyromonas gingivalis; identical to SEQ ID NO: 475

SEQ ID NO: 551 - DNA, 36 bp, Porphyromonas gingivalis; identical to SEQ ID NO: 391

SEQ ID NO: 552 - DNA, 36 bp, Porphyromonas gingivalis; identical to SEQ ID NO: 391

SEQ ID NO: 553 - DNA, 39 bp, Porphyromonas gingivalis
gttgtctccacccttctaactaagggtattcccaaccaa

SEQ ID NO: 554 - DNA, 37 bp, Porphyromonas gingivalis; identical to SEQ ID NO: 477

SEQ ID NO: 555 - DNA, 36 bp, Porphyromonas gingivalis; identical to SEQ ID NO: 425

SEQ ID NO: 556 - DNA, 37 bp, Prevotella aurantiaca
gttgtttttacctttcaaacagaaggcagatacaaca

SEQ ID NO: 557 - DNA, 36 bp, Bacteroides pyogenes; identical to SEQ ID NO: 480

SEQ ID NO: 558 - DNA, 36 bp, Prevotella intermedia; identical to SEQ ID NO: 414

SEQ ID NO: 559 - DNA, 36 bp, Prevotella falsenii
gttgtttgtgccttgcaaaaaggaggcagatgcaac

SEQ ID NO: 560 - DNA, 36 bp, Prevotella sp
gttgtagaagcttatcgtttggataggtatgacaac

SEQ ID NO: 561 - DNA, 36 bp, Prevotella pleuritidis
gttgcatctgccttctatttgagaggcacaaacaac

SEQ ID NO: 562 - DNA, 30 bp, Porphyromonas gingivalis; identical to SEQ ID NO: 393

SEQ ID NO: 563 - DNA, 36 bp, Porphyromonas gingivalis; identical to SEQ ID NO: 425

SEQ ID NO: 564 - DNA, 36 bp, Porphyromonas gingivalis; identical to SEQ ID NO: 426

SEQ ID NO: 565 - DNA, 37 bp, Porphyromonas gulae; identical to SEQ ID NO: 392

SEQ ID NO: 566 - DNA, 30 bp, Porphyromonas gulae; identical to SEQ ID NO: 393

SEQ ID NO: 567 - DNA, 36 bp, Porphyromonas gulae; identical to SEQ ID NO: 485

SEQ ID NO: 568 - DNA, 36 bp, Porphyromonas gulae; identical to SEQ ID NO: 485

SEQ ID NO: 569 - DNA, 36 bp, Porphyromonas gulae; identical to SEQ ID NO: 426

SEQ ID NO: 570 - DNA, 36 bp, Porphyromonas sp; identical to SEQ ID NO: 485

SEQ ID NO: 571 - DNA, 42 bp, Porphyromonas gulae; identical to SEQ ID NO: 487

SEQ ID NO: 572 - DNA, 36 bp, Porphyromonas gulae; identical to SEQ ID NO: 485

SEQ ID NO: 573 - DNA, 36 bp, Porphyromonas gulae; identical to SEQ ID NO: 485

SEQ ID NO: 574 - DNA, 36 bp, Porphyromonas gulae; identical to SEQ ID NO: 425

SEQ ID NO: 575 - DNA, 46 bp, Psychroflexus torquis; identical to SEQ ID NO: 415

SEQ ID NO: 576 - DNA, 47 bp, Psychroflexus torquis; identical to SEQ ID NO: 416

SEQ ID NO: 577 - DNA, 36 bp, Psychroflexus torquis; identical to SEQ ID NO: 417

SEQ ID NO: 578 - DNA, 36 bp, Psychroflexus torquis; identical to SEQ ID NO: 418

SEQ ID NO: 579 - DNA, 40 bp, Psychroflexus torquis; identical to SEQ ID NO: 419

SEQ ID NO: 580 - DNA, 36 bp, Capnocytophaga canimorsus; identical to SEQ ID NO: 461

SEQ ID NO: 581 - DNA, 36 bp, Capnocytophaga cynodegmi; identical to SEQ ID NO: 460

SEQ ID NO: 582 - DNA, 36 bp, Prevotella sp; identical to SEQ ID NO: 497

SEQ ID NO: 583 - DNA, 37 bp, Porphyromonas gingivalis
gttgtgtgtacccttcgaatagagggtagatccaaca

SEQ ID NO: 584 - DNA, 36 bp, Porphyromonas gingivalis; identical to SEQ ID NO: 467

SEQ ID NO: 585 - DNA, 36 bp, Porphyromonas gingivalis; identical to SEQ ID NO: 426

SEQ ID NO: 586 - DNA, 36 bp, Porphyromonas gingivalis; identical to SEQ ID NO: 467

SEQ ID NO: 587 - DNA, 36 bp, Porphyromonas gingivalis; identical to SEQ ID NO: 426

SEQ ID NO: 588 - DNA, 36 bp, Porphyromonas gingivalis; identical to SEQ ID NO: 426

SEQ ID NO: 589 - DNA, 36 bp, Porphyromonas gingivalis; identical to SEQ ID NO: 467

SEQ ID NO: 590 - DNA, 36 bp, Prevotella sp; identical to SEQ ID NO: 496

SEQ ID NO: 591 - DNA, 37 bp, Prevotella sp; identical to SEQ ID NO: 494

SEQ ID NO: 592 - DNA, 20 bp, Prevotella sp
gttgtaatagtccctcaaaa

SEQ ID NO: 593 - DNA, 36 bp, Phaeodactylibacter xiamenensis; identical to SEQ ID NO: 481

SEQ ID NO: 594 - DNA, 36 bp, Phaeodactylibacter xiamenensis; identical to SEQ ID NO: 30

SEQ ID NO: 595 - DNA, 36 bp, Porphyromonas gulae; identical to SEQ ID NO: 493

SEQ ID NO: 596 - DNA, 36 bp, Alistipes sp
gctgttatatccttacctttgtaagggaagtacagc

SEQ ID NO: 597 - DNA, 47 bp, Riemerella anatipestifer; identical to SEQ ID NO: 399

SEQ ID NO: 598 - DNA, 36 bp, Riemerella anatipestifer; identical to SEQ ID NO: 397

SEQ ID NO: 599 - DNA, 36 bp, Prevotella intermedia; identical to SEQ ID NO: 414

SEQ ID NO: 600 - DNA, 47 bp, Prevotella saccharolytica
gttgttgcttatagtacaaaggtattaaaattcaagcaaatcacaac

SEQ ID NO: 601 - DNA, 28 bp, Prevotella saccharolytica
tacctctcaaaaaggaggtagacacaac

SEQ ID NO: 602 - DNA, 29 bp, Prevotella saccharolytica
gtgtctacctcctttttgaggggtaaaaa

SEQ ID NO: 603 - DNA, 42 bp, Prevotella intermedia; identical to SEQ ID NO: 498

SEQ ID NO: 604 - DNA, 37 bp, Porphyromonas gingivalis; identical to SEQ ID NO: 392

SEQ ID NO: 605 - DNA, 39 bp, Porphyromonas gingivalis; identical to SEQ ID NO: 439

SEQ ID NO: 606 - DNA, 35 bp, Porphyromonas gingivalis; identical to SEQ ID NO: 440

SEQ ID NO: 607 - DNA, 36 bp, Porphyromonas gingivalis; identical to SEQ ID NO: 426

SEQ ID NO: 608 - DNA, 30 bp, Porphyromonas gingivalis; identical to SEQ ID NO: 393

SEQ ID NO: 609 - RNA, 36 nt, artificial sequence
  Synthetic
guugugauuacccuccaaaaugagagcaguuccaac

SEQ ID NO: 610 - RNA, 88 nt, artificial sequence
  Synthetic
guuggaacugcucucauuuuauucgugaguuuuuuauuuguuuucaaaggaacucaugaaugcaaagcauuuggaggguaaucacaac

SEQ ID NO: 611 - RNA, 36 nt, artificial sequence
  Synthetic
guuguuuuuaccuugcaaacagcaggcagaugcaac

SEQ ID NO: 612 - RNA, 36 nt, artificial sequence
  Synthetic
guugcaucugccuucuuuuugaaagguaaaaacaac

SEQ ID NO: 613 - RNA, 36 nt, artificial sequence
  Synthetic
guugucuccacccuucuaacuaaggguauucccaac

SEQ ID NO: 614 - RNA, 36 nt, artificial sequence
  Synthetic
guuguggaugccacuaguuugagugguauagacaac

SEQ ID NO: 615 - RNA, 36 nt, artificial sequence
  Synthetic
gcuguuauauccuuaccuuuguaagggaaguacagc

SEQ ID NO: 616 - RNA, 36 nt, artificial sequence
  Synthetic
guuguagaagcuuaucguuuggauagguaugacaac

SEQ ID NO: 617 - RNA, 37 nt, artificial sequence
  Synthetic
cuucguuauauuuucagcggaguucgugaauacuuaa

SEQ ID NO: 618 - RNA, 37 nt, artificial sequence
  Synthetic
guuguuuuuaccuuucaaacagaaggcagauacaaca

SEQ ID NO: 619 - RNA, 37 nt, artificial sequence
  Synthetic
guugguacuguacacguuuuuggugugcaaucacaac

SEQ ID NO: 620 - RNA, 86 nt, artificial sequence
  Synthetic
guugguacuguacacguuuuacuuacguugcuuuuauuuuaaauauaggaguucgugauuauaaauaauuggugugcaaucacaac

SEQ ID NO: 621 - RNA, 36 nt, artificial sequence
  Synthetic
guugggaaagcccuuauuuugaaggguaucuacaac

SEQ ID NO: 622 - RNA, 36 nt, artificial sequence; identical to SEQ ID NO: 614
  Synthetic

SEQ ID NO: 623 - RNA, 36 nt, artificial sequence; identical to SEQ ID NO: 609
  Synthetic

SEQ ID NO: 624 - RNA, 87 nt, artificial sequence
  Synthetic
guuggaacugcucucauuuuauucgugaaguuuuauuuguuuucaaaggaacucaugaaugcaaagcauuuggaggguaaucacaac

SEQ ID NO: 625 - RNA, 36 nt, artificial sequence; identical to SEQ ID NO: 204
  Synthetic

SEQ ID NO: 626 - RNA, 36 nt, artificial sequence
  Synthetic
guccuagucacuccucaaaccgggagccuaucggac

SEQ ID NO: 627 - RNA, 36 nt, artificial sequence
  Synthetic
guuggaucuacccucuauucgaaggguacacacaac

SEQ ID NO: 628 - RNA, 36 nt, artificial sequence
  Synthetic
guugggaauacccuuaguuagaaggguggagacaac

SEQ ID NO: 629 - RNA, 36 nt, artificial sequence
  Synthetic
guuggaucuacccucuauuugaaggguacacacaac

SEQ ID NO: 630 - RNA, 36 nt, artificial sequence; identical to SEQ ID NO: 629
  Synthetic

SEQ ID NO: 631 - RNA, 36 nt, artificial sequence
  Synthetic
guuguuugugccuugcaaaaaggaggcagaugcaac

SEQ ID NO: 632 - RNA, 31 nt, artificial sequence
  Synthetic
guuguuuuuaccuugcaaacagcaggcagau

SEQ ID NO: 633 - RNA, 36 nt, artificial sequence; identical to SEQ ID NO: 611
  Synthetic

SEQ ID NO: 634 - RNA, 22 nt, artificial sequence
  Synthetic
guuguuuuuaccuuucaaacag

SEQ ID NO: 635 - RNA, 36 nt, artificial sequence
  Synthetic
guugcaucugccuucuauuugagaggcacaaacaac

SEQ ID NO: 636 - RNA, 36 nt, artificial sequence; identical to SEQ ID NO: 635
  Synthetic

SEQ ID NO: 637 - RNA, 29 nt, artificial sequence
  Synthetic
  misc_feature (29)..(29): n is a, c, g, or u
gugucuaccuccuuuuugagggguaaaan

SEQ ID NO: 638 - RNA, 25 nt, artificial sequence
  Synthetic
cccucaaaacuggaccuuccacaac

SEQ ID NO: 639 - RNA, 36 nt, artificial sequence
  Synthetic
guuguaacugcccuuauuuugaaggguaaacacagc

SEQ ID NO: 640 - RNA, 36 nt, Bergeyella zoohelcum; identical to SEQ ID NO: 609

SEQ ID NO: 641 - RNA, 36 nt, Artificial Sequence; identical to SEQ ID NO: 611
  Synthetic

SEQ ID NO: 642 - DNA, 36 bp, Artificial Sequence; identical to SEQ ID NO: 414
  Synthetic

SEQ ID NO: 643 - RNA, 36 nt, Artificial Sequence; identical to SEQ ID NO: 612
  Synthetic

SEQ ID NO: 644 - DNA, 36 bp, Artificial Sequence; identical to SEQ ID NO: 462
  Synthetic

SEQ ID NO: 645 - RNA, 36 nt, Artificial Sequence; identical to SEQ ID NO: 613
  Synthetic

SEQ ID NO: 646 - DNA, 36 bp, Artificial Sequence; identical to SEQ ID NO: 391
  Synthetic

SEQ ID NO: 647 - RNA, 36 nt, Artificial Sequence; identical to SEQ ID NO: 614
  Synthetic

SEQ ID NO: 648 - DNA, 36 bp, Artificial Sequence; identical to SEQ ID NO: 480
  Synthetic

SEQ ID NO: 649 - DNA, 36 bp, Artificial Sequence
  Synthetic
caacagatatggtgagtttgatcaccgtaggtgttg

SEQ ID NO: 650 - RNA, 36 nt, Artificial Sequence; identical to SEQ ID NO: 615
  Synthetic

SEQ ID NO: 651 - DNA, 36 bp, Artificial Sequence; identical to SEQ ID NO: 596
  Synthetic

SEQ ID NO: 652 - DNA, 36 bp, Artificial Sequence
  Synthetic
cgacatgaagggaatgtttccattcctatattgtcg

SEQ ID NO: 653 - RNA, 36 nt, Artificial Sequence; identical to SEQ ID NO: 616
  Synthetic

SEQ ID NO: 654 - DNA, 36 bp, Artificial Sequence; identical to SEQ ID NO: 560
  Synthetic

SEQ ID NO: 655 - RNA, 37 nt, Artificial Sequence; identical to SEQ ID NO: 617
  Synthetic

SEQ ID NO: 656 - DNA, 34 bp, Artificial Sequence
  Synthetic
cttcgttatattttcagcggagttcgtgaatact

SEQ ID NO: 657 - RNA, 37 nt, Artificial Sequence; identical to SEQ ID NO: 618
  Synthetic

SEQ ID NO: 658 - DNA, 37 bp, Artificial Sequence; identical to SEQ ID NO: 556
  Synthetic

SEQ ID NO: 659 - RNA, 28 nt, Artificial Sequence
  Synthetic
uaccucucaaaaaggagguagacacaac

SEQ ID NO: 660 - DNA, 28 bp, Artificial Sequence
  Synthetic
tacctctcaaaaaggaggtagacacaac

SEQ ID NO: 661 - RNA, 37 nt, Artificial Sequence; identical to SEQ ID NO: 619
  Synthetic

SEQ ID NO: 662 - DNA, 37 bp, Artificial Sequence
  Synthetic
gttgtgattgcacaccaaaaacgtgtacagtaccaac

SEQ ID NO: 663 - DNA, 37 bp, Artificial Sequence
  Synthetic
caaccatgacatgtgcaaaaaccacacgttagtgttg

SEQ ID NO: 664 - RNA, 36 nt, Artificial Sequence; identical to SEQ ID NO: 621
  Synthetic

SEQ ID NO: 665 - DNA, 36 bp, Artificial Sequence; identical to SEQ ID NO: 411
  Synthetic

SEQ ID NO: 666 - DNA, 36 bp, Artificial Sequence; identical to SEQ ID NO: 403
  Synthetic

SEQ ID NO: 667 - RNA, 36 nt, Artificial Sequence; identical to SEQ ID NO: 626
  Synthetic

SEQ ID NO: 668 - DNA, 36 bp, Artificial Sequence; identical to SEQ ID NO: 30
  Synthetic

SEQ ID NO: 669 - RNA, 36 nt, Artificial Sequence; identical to SEQ ID NO: 627
  Synthetic

SEQ ID NO: 670 - DNA, 36 bp, Artificial Sequence; identical to SEQ ID NO: 426
  Synthetic

SEQ ID NO: 671 - DNA, 36 bp, Artificial Sequence
  Synthetic
caacctagatgggagataagcttcccatgtgtgttg

SEQ ID NO: 672 - RNA, 36 nt, Artificial Sequence; identical to SEQ ID NO: 628
  Synthetic

SEQ ID NO: 673 - DNA, 36 bp, Artificial Sequence; identical to SEQ ID NO: 425
  Synthetic

SEQ ID NO: 674 - RNA, 36 nt, Artificial Sequence; identical to SEQ ID NO: 629
  Synthetic

SEQ ID NO: 675 - DNA, 36 bp, Artificial Sequence; identical to SEQ ID NO: 485
  Synthetic

SEQ ID NO: 676 - DNA, 36 bp, Artificial Sequence
  Synthetic
caacctagatgggagataaacttcccatgtgtgttg

SEQ ID NO: 677 - RNA, 36 nt, Artificial Sequence; identical to SEQ ID NO: 629
  Synthetic

SEQ ID NO: 678 - DNA, 36 bp, Artificial Sequence; identical to SEQ ID NO: 485
  Synthetic

SEQ ID NO: 679 - DNA, 36 bp, Artificial Sequence; identical to SEQ ID NO: 676
  Synthetic

SEQ ID NO: 680 - RNA, 36 nt, Artificial Sequence; identical to SEQ ID NO: 631
  Synthetic

SEQ ID NO: 681 - DNA, 36 bp, Artificial Sequence; identical to SEQ ID NO: 559
  Synthetic

SEQ ID NO: 682 - RNA, 31 nt, Artificial Sequence; identical to SEQ ID NO: 632
  Synthetic

SEQ ID NO: 683 - DNA, 31 bp, Artificial Sequence
  Synthetic
gttgtttttaccttgcaaacagcaggcagat

SEQ ID NO: 684 - RNA, 22 nt, Artificial Sequence
  Synthetic
guuguuuuuaccuuucaaacag

SEQ ID NO: 685 - DNA, 22 bp, Artificial Sequence
  Synthetic
gttgtttttacctttcaaacag

SEQ ID NO: 686 - RNA, 36 nt, Artificial Sequence; identical to SEQ ID NO: 635
  Synthetic

SEQ ID NO: 687 - DNA, 36 bp, Artificial Sequence; identical to SEQ ID NO: 478
  Synthetic

SEQ ID NO: 688 - DNA, 36 bp, Artificial Sequence
  Synthetic
caacgtagacggaagataaactctccgtgtttgttg

SEQ ID NO: 689 - RNA, 36 nt, Artificial Sequence; identical to SEQ ID NO: 635
  Synthetic

SEQ ID NO: 690 - DNA, 36 bp, Artificial Sequence; identical to SEQ ID NO: 561
  Synthetic

SEQ ID NO: 691 - DNA, 36 bp, Artificial Sequence
  Synthetic
caacaaacacggagagtttatcttccgtctacgttg

SEQ ID NO: 692 - RNA, 29 nt, Artificial Sequence
  Synthetic
  misc_feature (29)..(29): n is a, c, g, or u
gugucuaccuccuuuuugagggguaaaan

SEQ ID NO: 693 - DNA, 29 bp, Artificial Sequence
  Synthetic
gtgtctacctcctttttgaggggtaaaaa

SEQ ID NO: 694 - RNA, 25 nt, Artificial Sequence
  Synthetic
cccucaaaacuggaccuuccacaac

SEQ ID NO: 695 - DNA, 25 bp, Artificial Sequence
  Synthetic
ccctcaaaactggaccttccacaac

SEQ ID NO: 696 - RNA, 36 nt, Artificial Sequence; identical to SEQ ID NO: 639
  Synthetic

SEQ ID NO: 697 - DNA, 36 bp, Artificial Sequence; identical to SEQ ID NO: 418
  Synthetic

SEQ ID NO: 698 - RNA, 88 nt, Artificial Sequence; identical to SEQ ID NO: 610
  Synthetic

SEQ ID NO: 699 - DNA, 74 bp, Artificial Sequence
  Synthetic
gttggaactgctctcattttattcgtgaagtttttatttgtttttaaaggaactcatgaatgcaaagcatttgg

SEQ ID NO: 700 - DNA, 36 bp, Artificial Sequence
  Synthetic
caaccttgacgagagtaaaacctcccattagtgttg

SEQ ID NO: 701 - RNA, 86 nt, Artificial Sequence; identical to SEQ ID NO: 620
  Synthetic

SEQ ID NO: 702 - DNA, 73 bp, Artificial Sequence
  Synthetic
gttggaactgctctcattttattcgtgaagttttatttgttttcaaaggaactcatgaatgcaaagcatttgg

SEQ ID NO: 703 - protein, 86 aa, Artificial Sequence
  Synthetic
  misc_feature (1)..(2): Xaa can be any naturally occurring amino acid
  misc_feature (10)..(10): Xaa can be any naturally occurring amino acid
  misc_feature (19)..(20): Xaa can be any naturally occurring amino acid
  misc_feature (45)..(45): Xaa can be any naturally occurring amino acid
  misc_feature (48)..(48): Xaa can be any naturally occurring amino acid
  misc_feature (77)..(77): Xaa can be any naturally occurring amino acid
  misc_feature (81)..(81): Xaa can be any naturally occurring amino acid
XXEKEEEQAXAQSLESLKXXLFLFLEKLQDLRNYYSHYKHSESSXEPXFDEGLLEKMYNDLLIAIRNAFSHNQYPMXNIEXFSLSS

SEQ ID NO: 704 - protein, 104 aa, Artificial Sequence
  Synthetic
KEVPIKERKENFKKNFRGIIKAVRDLRNFYTHKEHGEVEITDEIFGVLDEMLKSTVLTKPEDVNINQLKQEATDLEQKAFVLTYIRNKFAHNQLPKKEFWDYCQ

SEQ ID NO: 705 - protein, 104 aa, Artificial Sequence
  Synthetic
KEVPIKERKENFKKNFKGIIKAVRDLRNFYTHKEHGEVEITDEIFGVLDEMLKSTVLTEPEDVNINQLKQEATDLEQKAFVLTYIRNKFAHNQLPKKEFWDYCQ

SEQ ID NO: 706 - protein, 105 aa, Artificial Sequence
  Synthetic
LEEMQFKNRVICFRDVMKELLKTVEALRNFYTHYDHEPIKIEDRVFYFLDKVLLDVSLTNPEKVNITQLKQEATDLEQKAFVLTYIRNKFAHNQLPKKEFWDYCQ

SEQ ID NO: 707 - protein, 110 aa, Artificial Sequence
  Synthetic
IKERNRTIDLTLSQRIRQFREMLISLVTAVDQLRNFYTHYHHSDIVIENKVLDFLNSSFVSTALHKFKKEEIIQLGQAGEVEQDLYSLIYIRNKFAHNQLPIKEFFDFCE

SEQ ID NO: 708 - protein, 106 aa, Artificial Sequence
  Synthetic
ELENNLNTRVKNFKKNFIILAEAIEKLRDYTHFYHDPITFEDNKEPLLELLDEVLLKTILCNFDKIDFTGIASCSELEKKTIILIAIRNKFAHNQLPNKMIYDLAN

SEQ ID NO: 709 - protein, 98 aa, Artificial Sequence
  Synthetic
NNRAKFRSDLTTLFKSVDQLRNFYTHYYHKPLDFDASLFILLDDIFARTAKADFNNLDADVLETKSELVQLAFLVTAIRNKFAHNQLPAKEFYFYIRA

SEQ ID NO: 710 - protein, 91 aa, Artificial Sequence
  Synthetic
TNHNFEQTREIFELLLDTIKKLRDYYTHHYHKPITINPKIYDFLDDTLLDVLITDETITNPIIKKAIVLIIIRNKMAHNQYPPKFIYDLAN

SEQ ID NO: 711 - protein, 95 aa, Artificial Sequence
  Synthetic
DTTKQKEEKQAEAQSLESLKKSFFVFIYKLRDLRNHYSHYKHSKSLERPKFEEDLQEKMYNDLLIAVRNAFSHNQYPMRNRIAFANINPFSLSSA

SEQ ID NO: 712 - protein, 95 aa, Artificial Sequence
  Synthetic
DTTKQKEEKQAEAQSLESLRKSFFVFIYKLRDLRNHYSHYKHSKSLERPKFEEGLLEKMYNDLLIAVRNAFSHNQYPMRNRIAFANINPFSLSSA

SEQ ID NO: 713 - protein, 93 aa, Artificial Sequence
  Synthetic
DKEEVKEEKQAKAQSFKSLKDCLFLFLEKLQEARNYYSHYKYSESSKEPEFEEGLLEKMYNGLLVAVRNAFSHNQYPMYNSEVFKGMKLLSLS

SEQ ID NO: 714 - protein, 93 aa, Artificial Sequence
  Synthetic
DKEEVKEEKQAKAQSFKSLKDCLFLFLEKLQEARNYYSHYKSSESSKEPEFEEGLLEKMYNDLLVAIRNAFSHNQYPMYNSEVFKGMKLLSLS

SEQ ID NO: 715 - protein, 95 aa, Artificial Sequence
  Synthetic
DKEEVKQEKQAKAQSFDSLKHCLFLFLEKLQEARNYYSHYKYSESTKEPMLEKELLKKMYNKLLVAVRNAFSHNQYPMRNRIAFANINPFSLSSA

SEQ ID NO: 716 - protein, 95 aa, Artificial Sequence
  Synthetic
DKEEVKQEKQAEAQSLESLKDCLFLFLEKLQEARNYYSHYKYSESTKEPMLEEGLLEKMYNKLLVAVRNAFSHNQYPMRNRIAFANINPFSLSSA

SEQ ID NO: 717 - protein, 95 aa, Artificial Sequence
  Synthetic
DKKEVKQEKQAEAQSLESLKDCLFLFLDKLQEARNYYSHYKYSEFSKEPEFEEGLLEKMYNDFLIAVRNAFSHNQYPMHNKIEFANIKPFSLYTA

SEQ ID NO: 718 - protein, 95 aa, Artificial Sequence
  Synthetic
NNTKQKEEEQAKAQSFESLKDCLFLFLEKLREARNYYSHYKHSKSLEEPKLEEKLLENMYNKLLTEVRNAFSHNQYPMRDRIAFANIKPFSLSSA

SEQ ID NO: 719 - protein, 97 aa, Artificial Sequence
  Synthetic
KSPNNKEQREKEQSEALSLNNLKNVLFIFLEKLQVLRNYYSHYKYSEESPKPIFETSLLKNMYKNSLIAVRNAFSHNQYPMYDATLFAEVKKFTLFP

SEQ ID NO: 720 - protein, 97 aa, Artificial Sequence
  Synthetic
NKELTKKEKEELQANALSLDNLKSILFDFLQKLKDFRNYYSHYRHSGSSELPLFDGNMLQRLYNRLLIAVRNAFSHNQYPMYDEAVFSSIRKYDPSS

SEQ ID NO: 721 - protein, 97 aa, Artificial Sequence; identical to SEQ ID NO: 720
  Synthetic

SEQ ID NO: 722 - protein, 97 aa, Artificial Sequence
  Synthetic
KKELTKKEKEELQANALSLDNLKSILFDFLQKLKDFRNYYSHYRHPESSELPLFDGNMLQRLYNRLLIAVRNAFSHNQYPMYDEAVFSSIRKYDPSS

SEQ ID NO: 723 - protein, 98 aa, Artificial Sequence
  Synthetic
SNDSLKQTGEGDINDLLSLSNVKSMFFRLLQILEQLRNYYSHVKHSKSATMPNFDEDLLNWMRYTDFLKDVRNAFSHNQYPDSKKIAFRRIRKFNPKE

SEQ ID NO: 724 - protein, 99 aa, Artificial Sequence
  Synthetic
KGDEDPEVIQEAIANAFKMANVRKTLHAFLKQLEDLRNHFSHYNYNSPAKKMEVKFDDGFCNKLYYDFLIAVRNAFSHNQYPMSTNTVMQGIEKFNIQT

SEQ ID NO: 725 - protein, 93 aa, Artificial Sequence
  Synthetic
EQQKEKESEAQSQAEALNPSKLIEALEILVNQLHSLRNYYSHYKHKKPDAEKDIFKHLYKAFIASVRNAFCHNQYPFYKEALHAPIPLFTVAQ

SEQ ID NO: 726 - protein, 91 aa, Artificial Sequence
  Synthetic
KSYENRRETAECLDTIDRQKISSLLKEVYGKLQDIRNAFSHYHIDDQSVKHTALIISSEMHRFIENEFLVHIRNKSAHNQFPDLEIGKLPP

SEQ ID NO: 727 - protein, 91 aa, Artificial Sequence
  Synthetic
KSYENRRETTECLDTIDRQKISSLLKEVYGKLQDIRNAFSHYHIDDQSVKHTALIISSEMHRFIENEFLVHIRNKSAHNQFPDLEIGKLPP

SEQ ID NO: 728 - protein, 99 aa, Artificial Sequence
  Synthetic
SGIEKDHDSKTGVDPDSAQRLIRELYSLLDFLRNDFSHNRLDGTTFEHLKVSPDISSFITGSQYLILIRNKAAHNQFPCAAEMPLIYRDVSAKVGSIEG

SEQ ID NO: 729 - protein, 99 aa, Artificial Sequence
  Synthetic
SQIEKDHDSKTGVDPDSAQRLIRELYSLLDFLRNDFSHNRLDGTTFEHLEVSPDISSFITGSQYLILIRNKAAHNQFPCAAEMPLIYRDVSAKVGSIEG

SEQ ID NO: 730 - protein, 99 aa, Artificial Sequence
  Synthetic
KSTVQTEDETFAMLKGVSLADCLDIICLMADTLTECRNFYTHKDPYNKPSQLADQYLHQEMIAKKLDKVVVTDDERKLLVAIRNAFSHNSYNIDFSLIK

SEQ ID NO: 731 - protein, 84 aa, Artificial Sequence
  Synthetic
REYSNGKYKQNRVEVNSNDIFEVLKRAFGVLKMYRDLTNHYKTYEEKLIDGCEFLTSTEQPLSGMISKILRKIRNAFDHNNYPD

SEQ ID NO: 732 - protein, 81 aa, Artificial Sequence
  Synthetic
KQQNAEQAATYDINPEDIEFTLKGFFRLLNQMRNNYSHYISNTDYGKFDKLPVQDIYFKEKVMQLRNKFHHNEFPYFDWLI

SEQ ID NO: 733 - protein, 82 aa, Artificial Sequence
  Synthetic
DKAYSTEEVKVIVTDLVRRLCFYRNYFSHCFYLDTQYFYSDELVDTTAIGEKLADAGLCGIRNDVLHDNVISYADAIGKLSA

SEQ ID NO: 734 - RNA, 66 nt, Bergeyella zoohelcum
  misc_feature (1)..(30): n is a, c, g, or u
nnnnnnnnnnnnnnnnnnnnnnnnnnnnnnguugugauuacccuccaaaaugagagcaguuccaac

SEQ ID NO: 735 - RNA, 117 nt, Bergeyella zoohelcum
  misc_feature (1)..(30): n is a, c, g, or u
nnnnnnnnnnnnnnnnnnnnnnnnnnnnnnguuggaacugcucucauuuuauucgugaguuuuuauuguuuuuucaaaggaacucaugaaugcaaagcauuuggaggguaauaacaa

SEQ ID NO: 736 - protein, 57 aa, Artificial Sequence
  Synthetic
  misc_feature (3)..(7): Xaa can be any naturally occurring amino acid
  misc_feature (10)..(11): Xaa can be any naturally occurring amino acid
  misc_feature (17)..(17): Xaa can be any naturally occurring amino acid
  misc_feature (20)..(20): Xaa can be any naturally occurring amino acid
  misc_feature (22)..(22): Xaa can be any naturally occurring amino acid
  misc_feature (25)..(26): Xaa can be any naturally occurring amino acid
EFXXXXXLIXXIRNINXHYXHXFBXXBWIKENENEIINYRNIACHFHLPLLETFDNL

SEQ ID NO: 737 - protein, 56 aa, Artificial Sequence
  Synthetic
EFSIKLQKLINSIRNINNHYVHNFNDINLNEKKKNEGIRNKAFHFGIPDSKSYDQL

SEQ ID NO: 738 - protein, 55 aa, Artificial Sequence
  Synthetic
EFIENIKRLISDIRNINSHYIHRFDPLKIDNPQKLEDLRIKAINFDIPDTDYPSI

SEQ ID NO: 739 - protein, 26 aa, Artificial Sequence
  Synthetic
  misc_feature (1)..(2): Xaa can be any naturally occurring amino acid
  misc_feature (7)..(8): Xaa can be any naturally occurring amino acid
  misc_feature (13)..(13): Xaa can be any naturally occurring amino acid
  misc_feature (16)..(16): Xaa can be any naturally occurring amino acid
  misc_feature (20)..(22): Xaa can be any naturally occurring amino acid
  misc_feature (25)..(25): Xaa can be any naturally occurring amino acid
XXKKNEXXRNKAXHFXIPDXXXYDXL

SEQ ID NO: 740 - protein, 192 aa, Artificial Sequence
  Synthetic
GTTGTAACTGCCCTTATTTTGAAGGGTAAACACAACAAAGAAGCCCCCCAACCCCCGAAGGGGGAGCTACCAACTTTGCGTGTAAAATGGTCTTTGAAATTTTGTATTTAGAAATAATTATCTTTTTACATTTCAATGTTCCCCCTTTGGGGGTTAGGGGGCTAATGCCCTTATTTTGAAGGGTAAACACAA

SEQ ID NO: 741 - protein, 20 aa, Artificial Sequence
  Synthetic
GTTGTAACTGCCCTTATTTT

SEQ ID NO: 742 - protein, 75 aa, Artificial Sequence
  Synthetic
AAAGAAGCCCCCCAACCCCCGAAGGGGGAGCTACCAACTTTGCGTGTAAAATGGTCTTTGAAATTTTGTATTTAG

SEQ ID NO: 743 - protein, 16 aa, Artificial Sequence
  Synthetic
GTTGTAACTGCCCTTA

SEQ ID NO: 744 - protein, 115 aa, Artificial Sequence
  Synthetic
GTTGTAACTGCCCTTATTTTGAAGGGTAAAAACAACAAAGAAGCCCCCCGAAGGGGGAGCTACCAACATTGCGTATAAAATGTTCTTTGAAAATTTTTTATTTTGAAAAAAATGT

SEQ ID NO: 745 - protein, 67 aa, Artificial Sequence
  Synthetic
AAAGAAGCCCCCCGAAGGGGGAGCTACCAACTTTGCGTGTAAAATGGTCTTTGAAATTTTGTATTAG

SEQ ID NO: 746 - protein, 16 aa, Artificial Sequence
  Synthetic
GTTGTAACTGCCCTTA

SEQ ID NO: 747 - protein, 116 aa, Artificial Sequence
  Synthetic
GTTGTAACTGCCCTTATTTTGAAGGGTAAAAACAACAAAGAAGCCCCCCAACCCCCGAAGGGGGAGCTACCAACATTGCGTATAAATGTTCTTTGAAAATTTTTTGAAAAAAATGT

SEQ ID NO: 748 - protein, 20 aa, Artificial Sequence
  Synthetic
GTTGTAACTGCCCTTATTTT

SEQ ID NO: 749 - protein, 75 aa, Artificial Sequence; identical to SEQ ID NO: 742
  Synthetic

SEQ ID NO: 750 - protein, 122 aa, Artificial Sequence
  Synthetic
GTTGTAACTGCCCTTATTTTGAAGGGTAAAAACAACAAAGAAGCCCCCCAACCCCCGAAGGGGGAGCTACCAACATTGCGTATAAAATGTTCTTTGAAAATTTTTTATTTTGAAAAAAATGT

SEQ ID NO: 751 - protein, 20 aa, Artificial Sequence
  Synthetic
GTTGTAACTGCCCTTATTTT

SEQ ID NO: 752 - protein, 16 aa, Artificial Sequence
  Synthetic
GTTGTAACTGCCCTTA

SEQ ID NO: 753 - protein, 74 aa, Artificial Sequence
  Synthetic
AAAGAAGCCCCCCAACCCCCGAAGGGGGAGCTACCAACTTTGCGTGTAAAATGGTCTTTGAAATTTTGTATTAG

SEQ ID NO: 754 - protein, 16 aa, Artificial Sequence
  Synthetic
GTTGTAACTGCCCTTA

SEQ ID NO: 755 - protein, 121 aa, Artificial Sequence
  Synthetic
GTTGTAACTGCCCTTATTTTGAAGGGTAAAAACAACAAAGAAGCCCCCAACCCCCGAAGGGGGAGCTACCAACATTGCGTATAAAATGTTCTTTGAAAATTTTTTATTTTGAAAAAAATGT

SEQ ID NO: 756 - protein, 20 aa, Artificial Sequence
  Synthetic
GTTGTAACTGCCCTTATTTT

SEQ ID NO: 757 - protein, 36 aa, Artificial Sequence
  Synthetic
GTTGTAACTGCCCTTATTTTGAAGGGTAAACACAAC

SEQ ID NO: 758 - protein, 36 aa, Artificial Sequence
  Synthetic
GTTGTAAGTGCCATTCGTTTGAAAGGTAAAAACAAC

SEQ ID NO: 759 - RNA, 241 nt, Artificial Sequence
  Synthetic
gauggggguguucugcugguaguggucggcgagcugcacgcugccguccucgauguuguggcggaucuugaaguucaccuugaugccguucuucugcuugucggccaugauauagacguuguggcuguuguaguuguacuccagcuugugccccaggauguugccguccuccuugaagucgaugcccuucagcucgaugcgguucaccagggugucgcccucgaacuucaccucggcgcgg

SEQ ID NO: 760 - RNA, 295 nt, Artificial Sequence
  Synthetic
cgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcaggugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguu

SEQ ID NO: 761 - RNA, 66 nt, BERGEYELLA ZOOHELCUM
  misc_feature (1)..(30): n is a, c, g, or u
nnnnnnnnnnnnnnnnnnnnnnnnnnnnnnguuggaacugcucucauuuuggaggguaaucacaac

SEQ ID NO: 762 - RNA, 36 nt, BERGEYELLA ZOOHELCUM; identical to SEQ ID NO: 204

SEQ ID NO: 763 - RNA, 118 nt, BERGEYELLA ZOOHELCUM
  misc_feature (1)..(30): n is a, c, g, or u
nnnnnnnnnnnnnnnnnnnnnnnnnnnnnnguuggaacugcucucauuuuauucgugaguuuuuauuguuuuuucaaaggaacucaugaaugcaaagcauuuggaggguaaucacaac

SEQ ID NO: 764 - RNA, 88 nt, BERGEYELLA ZOOHELCUM
guuggaacugcucucauuuuauucgugaguuuuuauuguuuuuucaaaggaacucaugaaugcaaagcauuuggaggguaaucacaac

SEQ ID NO: 765 - RNA, 66 nt, Artificial Sequence
  Synthetic
  misc_feature (1)..(30): n is a, c, g, or u
nnnnnnnnnnnnnnnnnnnnnnnnnnnnnnguugcaucugccuucuuuuugaaagguaaaaacaac

SEQ ID NO: 766 - RNA, 36 nt, Artificial Sequence; identical to SEQ ID NO: 612
  Synthetic

SEQ ID NO: 767 - RNA, 42 nt, Artificial Sequence
  Synthetic
cuuuauguauugaucuuccucgcgaucuuucucucgaaauuu

SEQ ID NO: 768 - RNA, 30 nt, Artificial Sequence
  Synthetic
cgagagaaagaucgcgaggaagaucaauac

SEQ ID NO: 769 - RNA, 43 nt, Artificial Sequence
  Synthetic
ugucgaagacaacaaagaaguucaacucuuuauguauugaucu

SEQ ID NO: 770 - RNA, 30 nt, Artificial Sequence
  Synthetic
uacauaaagaguugaacuucuuuguugucu

SEQ ID NO: 771 - RNA, 42 nt, Artificial Sequence
  Synthetic
guagggaacggaguguuuacaguuccgaagaauaauaaaaua

SEQ ID NO: 772 - RNA, 30 nt, Artificial Sequence
  Synthetic
auuauucuucggaacuguaaacacuccguu

SEQ ID NO: 773 - RNA, 36 nt, Prevotella sp.
guuguggaagguccaguuuugaggggcuauuacaac

SEQ ID NO: 774 - RNA, 36 nt, Bergeyella zoohelcum; identical to SEQ ID NO: 204

SEQ ID NO: 775 - RNA, 36 nt, Porphyromonas gingivalis; identical to SEQ ID NO: 628

SEQ ID NO: 776 - RNA, 36 nt, Alistipes sp; identical to SEQ ID NO: 615

SEQ ID NO: 777 - RNA, 36 nt, Flavobacterium branchophilum
guuguaacugcccuuauuuugaaggguaaacacaac

SEQ ID NO: 778 - RNA, 36 nt, Flavobacterium columnare; identical to SEQ ID NO: 621

SEQ ID NO: 779 - RNA, 36 nt, Paledibacter propionicigenes
guuguaagugcccuucauuugaaagguagaaacaac

SEQ ID NO: 780 - RNA, 36 nt, Phaeodactylibacter xiamenensis; identical to SEQ ID NO: 626

SEQ ID NO: 781 - RNA, 36 nt, Bacterioides pyogenes; identical to SEQ ID NO: 614

SEQ ID NO: 782 - RNA, 36 nt, Prevotella sp.
guuguacaagcuuauccuuuggauagguaugacaac

SEQ ID NO: 783 - RNA, 36 nt, Prevotella sp.
guuguggaagguccaguuuugagggacuauuacaac

SEQ ID NO: 784 - RNA, 37 nt, Myroides odoratimimus; identical to SEQ ID NO: 619

SEQ ID NO: 785 - RNA, 36 nt, Porphyromonas gulae; identical to SEQ ID NO: 629

SEQ ID NO: 786 - RNA, 36 nt, Prevotella aurantiaca
guuguaucugccuucuguuugaaagguaaaaacaac

SEQ ID NO: 787 - RNA, 36 nt, Prevotella buccae
guugcaugugccuucuuuuugaaagguaaaaacaac

SEQ ID NO: 788 - RNA, 36 nt, Prevotella pallens
guugcaucugccugcuguuugcaagguaaaaacaac

SEQ ID NO: 789 - RNA, 36 nt, Porphyromonas gingivalis; identical to SEQ ID NO: 627

SEQ ID NO: 790 - RNA, 36 nt, Prevotella falsenii
guugcaucugccuccuuuuugcaaggcacaaacaac

SEQ ID NO: 791 - RNA, 36 nt, Prevotella pleuritidis; identical to SEQ ID NO: 635

SEQ ID NO: 792 - RNA, 36 nt, Riemerella anatipestifer
guugggacugcucucauuuugaaggguauucacaac

SEQ ID NO: 793 - RNA, 42 nt, Artificial Sequence; identical to SEQ ID NO: 767
  Synthetic

SEQ ID NO: 794 - RNA, 30 nt, Artificial sequence
  Synthetic
cauaacuagaaggagcgcuagaaagagagc

SEQ ID NO: 795 - RNA, 43 nt, Artificial sequence; identical to SEQ ID NO: 769
  Synthetic

SEQ ID NO: 796 - RNA, 30 nt, Artificial sequence
  Synthetic
ucuguuguuucuucaaguugagaaauacau

SEQ ID NO: 797 - RNA, 42 nt, Artificial Sequence; identical to SEQ ID NO: 771
  Synthetic

SEQ ID NO: 798 - RNA, 30 nt, Artificial Sequence
  Synthetic
uugccucacaaaugucaaggcuucuuauua

SEQ ID NO: 799 - RNA, 30 nt, Artificial Sequence; identical to SEQ ID NO: 796
  Synthetic

SEQ ID NO: 800 - RNA, 43 nt, Artificial Sequence; identical to SEQ ID NO: 769
  Synthetic

What is claimed:

1. A method for identifying and generating novel nucleic acid modifying effectors, comprising:
   a computer-implemented method comprising:
   (a) identifying putative nucleic acid modifying loci from a set of nucleic acid sequences, the set of nucleic acid sequences obtained from a genomic or metagenomic database and the nucleic acid sequences are long enough to encode a protein with a defined size limit greater than 700 amino acids, wherein the putative nucleic acid modifying loci: are a defined distance between 1 and 25kb of a CRISPR array, the CRISPR array being identified using a repeat or pattern finding analysis of the set of nucleic acid sequences, and comprise only one sequence encoding a protein with a defined size limit greater than 700 amino acids;
   (b) identifying candidate effector proteins that are the protein with greater than 700 amino acids in (a) and homologous proteins thereof;
   (c) grouping the candidate effector proteins into subsets based on homology;
   (d) selecting the subsets that have at least 10 candidate effector proteins and more than 50% of the candidate effector proteins within 10 kb of the CRISPR array,
   (e) identifying a candidate set of novel nucleic acid modifying effectors proteins by selecting from one or more of the subsets selected in (d) based on one or more of the following:
   subsets comprising loci of coding sequences for putative candidate effector proteins with no more than 90% homology matches to known protein domains relative to loci in other subsets,
   subsets whose loci have same orientations as putative adjacent accessory proteins relative to effector proteins in other subsets,
   subsets comprising candidate effector proteins with lower existing nucleic acid modifying classifications relative to other subsets,
   subsets comprising loci with a lower proximity to known nucleic acid modifying loci relative to other subsets, and
   total number of candidate effector proteins in each subset; and
   generating nucleic acid molecules encoding one or more of the nucleic acid modifying proteins in the candidate set identified by the computer-implemented method; and
   expressing the one or more nucleic acid modifying proteins from the generated nucleic acid molecules and performing one or more biochemical y assays that validate a level of nucleic acid modifying function of the one or more novel nucleic acid modifying proteins.

2. The method of claim 1, wherein the genomic or metagenomic database comprises prokaryotic genomic or metagenomic sequences.

3. The method of claim 1, wherein the defined distance from the CRISPR array is between 10kb and 25 kb.

4. The method of claim 1, wherein the defined distance is within 10 kb of the CRISPR array.

5. The method of claim 1, wherein said repeat or pattern finding analysis comprises PILER-CR.

6. The method of claim 1, wherein said grouping step is based, at least in part, on results of a domain homology search or an HHpred protein domain homology search.

7. The method of claim 6, wherein the domain homology search or HHpred protein domain homology search is performed using a defined threshold that is a BLAST nearest-neighbor cut-off value of 0 to 1e-7.

8. The method of claim 1, further comprising a filtering step that includes only loci with coding sequences for putative proteins of a size between 900 and 1800 amino acids.

9. The method of claim 1, wherein said validation comprises PAM validation in bacterial colonies, in vitro cleavage assays, the Surveyor method, experiments in mammalian cells, PFS validation, or a combination thereof.

10. The method of claim 1, further comprising preparing a non-naturally occurring or engineered composition for modifying a target nucleic acid sequence, the composition comprising one or more novel nucleic acid modifying effectors proteins.

11. The method of claim 10, wherein the loci further comprise coding sequences for one or two small accessory proteins within 2 kb to 10kb of the CRISPR array.

12. The method of claim 11, wherein the small accessory protein comprises multiple predicted transmembrane domains.

13. The method of claim 12, wherein the small accessory protein comprises four predicted transmembrane domains.

14. The method of claim 11, wherein the small accessory protein comprises at least one HEPN domain.

15. The method of claim 11, wherein the small accessory protein comprises at least one HEPN domain and at least one transmembrane domain.

16. The method of claim 1, wherein the one or more novel nucleic acid modifying effectors proteins is one or more Class 2 CRISPR effectors.

17. The method of claim 1, wherein the one or more novel nucleic acid modifying effectors proteins have loci that the identified loci lack coding sequences for Cas1 or Cas2.

18. The method of claim 1, wherein the single effector protein is greater than 900, or greater than 1100 amino acids in length.

19. The method of claim 18, wherein the single effector comprises at least one HEPN domain.

20. The method of claim 19, wherein the at least one HEPN domain is near an N- or C-terminus of the effector protein.

21. The method of claim 20, wherein the at least one HEPN domain is located in an interior position of the effector protein.

22. The method of claim 19, wherein the single large effector protein comprises a HEPN domain at the N- and C-terminus and two HEPN domains internal to the protein.

23. The method of claim 1, wherein the loci comprise no additional coding sequence for proteins out to 25 kb from the CRISPR array.

24. The method of claim 1, wherein the CRISPR array comprises direct repeat sequences comprising about 36 nucleotides in length.

25. The method of claim 24, wherein the direct repeat comprises a GTTG/GUUG at the 5' end that is reverse complementary to a CAAC at the 3' end.

26. The method of claim 1, wherein the CRISPR array comprises spacer sequences comprising about 30 nucleotides in length.

27. The method of claim 1, wherein said loci lack a coding sequence for a small accessory protein.

\* \* \* \* \*